United States Patent
Dauner et al.

(10) Patent No.: US 9,181,566 B2
(45) Date of Patent: Nov. 10, 2015

(54) GENETIC SWITCHES FOR BUTANOL PRODUCTION

(71) Applicant: BUTAMAX(TM) ADVANCED BIOFUELS LLC, Wilmington, DE (US)

(72) Inventors: Michael Dauner, Wilmington, DE (US); Arthur Leo Kruckeberg, Wilmington, DE (US); Robert A Larossa, Chadds Ford, PA (US); Brian James Paul, Wilmington, DE (US); Wonchul Suh, Hockessin, DE (US); Joseph Frederich Tuminello, Wilmington, DE (US)

(73) Assignee: BUTAMAX ADVANCED BIOFUELS LLC, Wilmington, DE (US)

( * ) Notice: Subject to any disclaimer, the term of this patent is extended or adjusted under 35 U.S.C. 154(b) by 0 days.

(21) Appl. No.: 13/730,742

(22) Filed: Dec. 28, 2012

(65) Prior Publication Data

US 2014/0004526 A1 Jan. 2, 2014

Related U.S. Application Data

(60) Provisional application No. 61/581,888, filed on Dec. 30, 2011.

(51) Int. Cl.
  *C12P 7/26* (2006.01)
  *C12P 7/16* (2006.01)

(52) U.S. Cl.
  CPC ... *C12P 7/16* (2013.01); *C12P 7/26* (2013.01); *C12Y 101/01001* (2013.01); *C12Y 101/01008* (2013.01); *C12Y 101/01043* (2013.01); *C12Y 101/01047* (2013.01); *C12Y 101/01086* (2013.01); *C12Y 202/01006* (2013.01); *C12Y 203/01008* (2013.01); *C12Y 301/01031* (2013.01); *C12Y 301/03009* (2013.01); *C12Y 401/02009* (2013.01); *Y02E 50/10* (2013.01)

(58) Field of Classification Search
  None
  See application file for complete search history.

(56) References Cited

U.S. PATENT DOCUMENTS

| | | | |
|---|---|---|---|
| 5,541,084 A | 7/1996 | Van Arsdell et al. | |
| 6,004,779 A | 12/1999 | Bradley et al. | |
| 6,379,942 B1 | 4/2002 | Davis et al. | |
| 6,576,469 B1 | 6/2003 | Struhl et al. | |
| 7,851,188 B2 | 12/2010 | Donaldson et al. | |
| 7,910,342 B2 | 3/2011 | Liao et al. | |
| 8,129,162 B2 | 3/2012 | Li et al. | |
| 8,188,250 B2 | 5/2012 | Bramucci et al. | |
| 8,206,970 B2 | 6/2012 | Eliot et al. | |
| 2003/0083480 A1 | 5/2003 | Castle et al. | |
| 2003/0166191 A1 | 9/2003 | Gardner et al. | |
| 2004/0018625 A1 | 1/2004 | Struhl et al. | |
| 2004/0058429 A1 | 3/2004 | Bill et al. | |
| 2007/0092957 A1 | 4/2007 | Donaldson et al. | |
| 2007/0178505 A1 | 8/2007 | Fischer et al. | |
| 2007/0259410 A1 | 11/2007 | Donaldson et al. | |
| 2007/0292927 A1 | 12/2007 | Donaldson et al. | |
| 2008/0182308 A1 | 7/2008 | Donaldson et al. | |
| 2008/0293101 A1 | 11/2008 | Peters et al. | |
| 2009/0155870 A1 | 6/2009 | Donaldson et al. | |
| 2009/0239275 A1 | 9/2009 | Donaldson et al. | |
| 2009/0269823 A1 | 10/2009 | Bramucci et al. | |
| 2009/0305363 A1 | 12/2009 | Anthony et al. | |
| 2010/0035320 A1* | 2/2010 | Blanchard et al. | 435/170 |
| 2010/0081154 A1 | 4/2010 | Flint et al. | |
| 2010/0120105 A1 | 5/2010 | Anthony et al. | |
| 2010/0143997 A1 | 6/2010 | Buelter et al. | |
| 2010/0175141 A1 | 7/2010 | Collins et al. | |
| 2010/0197519 A1 | 8/2010 | Li et al. | |
| 2010/0272698 A1 | 10/2010 | Stateva et al. | |
| 2011/0020865 A1 | 1/2011 | Payne et al. | |
| 2011/0053235 A1 | 3/2011 | Festel et al. | |
| 2011/0076733 A1 | 3/2011 | Urano et al. | |
| 2011/0124060 A1 | 5/2011 | Anthony et al. | |
| 2011/0183393 A1 | 7/2011 | Dundon et al. | |
| 2011/0201072 A1 | 8/2011 | Bastian et al. | |
| 2011/0250660 A1 | 10/2011 | Liao et al. | |
| 2011/0262982 A1 | 10/2011 | Liao et al. | |
| 2011/0269199 A1 | 11/2011 | Satagopan et al. | |
| 2012/0040440 A1 | 2/2012 | Alsaker et al. | |
| 2012/0064561 A1 | 3/2012 | Flint et al. | |
| 2012/0149080 A1 | 6/2012 | Nagarajan et al. | |
| 2012/0156735 A1 | 6/2012 | Dauner et al. | |
| 2012/0237988 A1 | 9/2012 | Anthony et al. | |
| 2013/0071898 A1 | 3/2013 | Anthony et al. | |
| 2013/0203138 A1 | 8/2013 | McElvain et al. | |

FOREIGN PATENT DOCUMENTS

| | | |
|---|---|---|
| DE | 19923950 A1 | 1/2001 |
| DE | 10116101 B4 | 7/2005 |
| EP | 1526180 A1 | 4/2005 |
| WO | WO 2008/119735 A1 | 10/2008 |
| WO | WO 2008/144060 A2 | 11/2008 |
| WO | WO 2008144060 A2 * | 11/2008 |
| WO | WO 2011/019894 A1 | 2/2011 |
| WO | WO 2011/149353 A1 | 12/2011 |

OTHER PUBLICATIONS

Brock et al., Biology of Microorganisms, Prentice-Hall, Englewood Cliffs, N J, 1984, pp. 285-286.*
Fischer et al., Metabolic Engineering, 2008, vol. 10, pp. 295-304.*
Amador-Noguez, D., et al., "Metabolome remodeling during the acidogenic-solventogenic transition in *Clostridium acetobutylicum*," *Appl. Environ. Microbiol.* 77:7984-7997, American Society for Microbiology, Washington (Nov. 2011).

(Continued)

*Primary Examiner* — Michele K Joike
*Assistant Examiner* — Mindy G Brown

(57) ABSTRACT

The invention relates to suitable screening strategies for evaluating various candidate promoters for differential gene expression during the propagation and production phases of a fermentation process. The invention also relates to recombinant host cells that comprise identified promoter nucleic acid sequences and methods for producing fermentation products employing the same.

6 Claims, 10 Drawing Sheets

(56) References Cited

OTHER PUBLICATIONS

Badis, G., et al., "A new library of yeast transcription factor motifs reveals a widespread function for Rsc3 in targeting nucleosome exclusion at promoters," Mol. Cell. 32:878-887, Cell Press, Cambridge, MA (Dec. 2008).

Boles, E., et al., "The role of the NAD-dependent glutamate dehydrogenase in restoring growth on glucose of a Saccharomyces cerevisiae phosphoglucose isomerase mutant," Eur. J. Biochem. 217:469-477, Springer, England (Oct. 1993).

Diderich, J.A., et al., "Glucose uptake kinetics and transcription of HXT genes in chemostat cultures of Saccharomyces cerevisiae," J. Biol. Chem. 274:15350-15359, American Society for Biochemistry and Molecular Biology, Baltimore, Maryland (May 1999).

Grimmler, C., et al., "Genome-wide gene expression analysis of the switch between acidogenesis and solventogenesis in continuous cultures of Clostridium acetobutylicum," J. Molec. Microbiol. Biotechnol. 20:1-15, Horizon Scientific Press, Switzerland (Jan. 2011).

Heux, S., et al., "Glucose utilization of strains lacking PGI1 and expressing a transhydrogenase suggests differences in the pentose phosphate capacity among Saccharomyces cerevisiae strains," FEMS Yeast Res. 8:217-224, Elsevier Science B.V., England (Mar. 2008).

Janssen, H., et al., "A proteomic and transcriptional view of acidogenic and solventogenic steady-state cells of Clostridium acetobutylicum in a chemostat culture," Appl. Microbiol. Biotechnol. 87:2209-2226, Springer International, Germany (Jul. 2010).

Kwast, K.E., et al., "Oxygen sensing and the transcriptional regulation of oxygen-responsive genes in yeast," J. Exp. Biol. 201:1177-1195, Cambridge Univ. Press, London, England (Apr. 1998).

Kresnowati, M.T., et al., "When transcription meets metabolome: fast cellular responses of yeast to sudden relief of glucose limitation," Mol. Syst. Biol. 2:49, Nature Pub. Group, England (Sep. 2006).

Kundaje, A., et al., "A predictive model of the oxygen and heme regulatory network in yeast," PLoS Comput. Biol. 4:e1000224, Public Library of Science, San Francisco, California (Nov. 2008).

Lai, L.C., et al., "Dynamical remodeling of the transcriptome during short-term anaerobiosis in Saccharomyces cerevisiae: differential response and role of Msn2 and/or Msn4 and other factors in galactose and glucose media," Mol. Cell Biol. 25:4075-4091, American Society for Microbiology, Washington, D.C. (May 2005).

Li, B.-Z., et al., "Genome-wide transcriptional analysis of Saccharomyces cerevisiae during industrial bioethanol fermentation," J. Ind. Microbiol. Biotechnol. 37:43-55, Stockton Press, England (Jan. 2010).

Mao, S., et al., "Proteome reference map and comparative between a wild type Clostridium acetobutylicum DSM 1731 and its mutant with enhanced butanol tolerance and butanol yield," J. Proteome Res. 9:3058-3059, American Chemical Society, Washington, D.C. (Jun. 2010).

Matys, V., et al., "TRANSFAC®: transcriptional regulation, from patterns to profiles," Nucleic Acids Res. 31:374-378, Oxford University Press, London (Jan. 2006).

Ozcan, S., et al., "Function and regulation of yeast hexose transporters," Microbiol. Mol. Biol. Rev. 63:554-569, American Society for Microbiology, United States (Sep. 1999).

Rintala, E., et al., "Transcription of hexose transporters of Saccharomyces cerevisiae is affected by change in oxygen provision," BMC Microbiol. 18:53, BioMed Central, London, England (Mar. 2008).

Scotcher, M., et al., "Expression of abrB310 and SinR, and effects of decreased abrB310 expression on the transition from acidogenesis to solventogenesis in Clostridium acetobutylicum ATCC824," Appl. Environ. Microbiol. 71:1987-1995, American Society for Microbiology, Washington (Apr. 2005).

Tse, M.T., et al., "The oxygenase reaction of acetolactase synthase," Biochem. 32:10398-10403, American Chemical Society, Washington (Oct. 1993).

Ter Linde, J.J., et al., "Genome-wide transcriptional analysis of aerobic and anaerobic chemostat cultures of Saccharomyces cerevisiae," J. Bacteriol. 181:7409-7413, American Society for Microbiology, Baltimore, Maryland (Dec. 1999).

Van Den Brink, J., et al., "New insights into the Saccharomyces cerevisiae fermentation switch: dynamic transcriptional response to anaerobicity and glucose-excess," BMC Genomics 9:100, BioMed Central, London, England (Feb. 2008).

Van Maris, A.J., et al., "Directed evolution of pyruvate decarboxylase-negative Saccharomyces cerevisiae, yielding a C2-independent, glucose-tolerant, and pyruvate-hyperproducing yeast," Appl. Environ. Microbiol. 70:159-166, American Society for Microbiology, Washington (Jan. 2004).

Wang, Y., et al., "Ras and Gpa2 mediate one branch of a redundant glucose signaling pathway in yeast," PLoS Biol. 2:E128, Public Library of Science, San Francisco, California (May 2004).

International Search Report for Int'l Appl. No. PCT/US2012/072186, mailed Sep. 4, 2013, European Patent Office, Rijswijk, The Netherlands.

Prielhofer et al., "Induction without methanol: novel regulated promoters enable high-level expression in Pichia pastoris," Microbial Cell Factories 12:5 (2013).

Ter Linde, J.J.M., et al. "Transcriptional regulation of YML083c under aerobic and anaerobic conditions," Yeast 20:439-54 (2003).

Nevoigt et al., "Engineering promoter regulation," Biotechnol. Bioteng. 96(3):550-8 (2007).

Cohen et al.., "Induction and repression of DAN1 and the family of anaerobic mannoprotein genes in Saccharomyces cerevisiae occurs through a complex array of regulatory sites," Nucleic Acids Res. 29(3):799-808 (2001).

Brauer, M., et al., "Coordination of growth rate, cell cycle, stress response, and metabolic activity in yeast," Mol. Biol. Cell. 19(1):352-67 (2008).

Becerra, M., et al., "Genome-wide analysis of the yeast transcriptome upon heat and cold shock," Comp. Func. Genomics 4(4):366-75 (2003).

Al-Fageeh, M.B., et al. "Control and regulation of the cellular responses to cold shock: the responses in yeast and mammalian systems," Biochem. J. 397(2):247-59 (2006).

Balasubramanian, B., et al., "The Rox1 repressor of Saccharomyces cerevisiae hypoxic genes is a specific DNA-binding protein with a high-mobility-group motif," Mol. Cell Bol. 13(10):6071-8 (1993).

Macisaac, K.D., et al., "An improved map of conserved Saccharomyces cerevisiae," BMC Bioinformatics 7:113 (2006).

Kwast, K. E., et al., "Genomic analyses of anaerobically induced genes in Saccharomyces cerevisiae: functional roles of Rox1 and the factors in mediating the anoxic response," J. Bacteriology 184:250-6 (2002).

Wiebe M.G., et al., "Central carbon metabolism of Saccharomyces cerevisiae in anaerobic, oxygen-limited and fully aerobic steady-state conditions and following a shift to anaerobic conditions," FEMS Yeast Res. 8:140-154 (2008).

Lai, L.C., et al., "Metabolic-state-dependent remodeling of the transcriptome in response to anoxia and subsequent reoxygenation in Saccharomyces cerevisiae," Eukaryot. Cell 5(9):1468-89 (2006).

Goh et al., "Transcriptional modulation of bacterial gene expression by subinhibitory concentrations of antibiotics," PNAS 99:17025 (2002).

Ligr et al., "Gene expression from random libraries of yeast promoters," Genetics 172:2113-22 (2006).

Alper et al., "Tuning genetic control through promoter engineering," PNAS 102:12678-83 (2005).

Nevoigt et al., "Engineering of promoter replacement cassettes for fine-tuning of gene expression in Saccharomyces cerevisiae," AEM 72:5266 (2006).

Belli et al., "Functional analysis of yeast essential genes using a promoter-substitution cassettes and the tetracycline-regulatable dual expression system," Yeast 14:1127-38 (1998).

Guldener U., et al., "A new efficient gene disruption cassette for repeated use in budding yeast," Nucleic Acids Res. 24:2519-24 (1996).

\* cited by examiner

US 9,181,566 B2

GENETIC SWITCHES FOR BUTANOL PRODUCTION

CROSS-REFERENCE TO RELATED APPLICATIONS

This application claims priority under 35 U.S.C. §119(e) to U.S. Provisional Patent Application Ser. No. 61/581,888, filed on Dec. 30, 2011, and incorporated herein by reference in its entirety.

FIELD OF THE INVENTION

The invention relates to the fields of industrial microbiology and alcohol production. Embodiments of the invention relate to the identification of suitable promoters for use in differential regulation of the expression of genes during propagation and production phases to achieve lower alkyl alcohol production via an engineered pathway in microorganisms.

REFERENCE TO SEQUENCE LISTING SUBMITTED ELECTRONICALLY VIA EFS-WEB

The content of the electronically submitted Sequence Listing (Name: 20121228_CL5192USNP_SEQLIST_final_ST25.txt; Size: 1,882,796 bytes; Date of Creation: Dec. 28, 2012), filed herewith, is herein incorporated by reference in its entirety.

BACKGROUND

Butanol is an important industrial chemical, useful as a fuel additive, as a feedstock chemical in the plastics industry, and as a food grade extractant in the food and flavor industry. Each year 10 to 12 billion pounds of butanol are produced by petrochemical means and the need for this commodity chemical will likely increase in the future.

Methods for the chemical synthesis of isobutanol are known, such as oxo synthesis, catalytic hydrogenation of carbon monoxide (Ullmann's Encyclopedia of Industrial Chemistry, 6th edition, 2003, Wiley-VCHVerlag GmbH and Co., Weinheim, Germany, Vol. 5, pp. 716-719) and Guerbet condensation of methanol with n-propanol (Carlini et al., *J. Molec. Catal. A:Chem.* 220:215-220, 2004). These processes use starting materials derived from petrochemicals, are generally expensive, and are not environmentally friendly. The production of isobutanol from plant-derived raw materials would minimize green house gas emissions and would represent an advance in the art.

BRIEF SUMMARY OF THE INVENTION

Provided herein are methods of producing fermentation products. In embodiments, the methods comprise: A) contacting a recombinant host cell comprising a heterologous polynucleotide, said heterologous polynucleotide comprising i) a promoter nucleic acid sequence; and ii) a nucleic acid sequence encoding a biocatalyst polypeptide with a carbon substrate under a first set of conditions; and B) contacting the recombinant host cell with a carbon substrate under a second set of conditions; wherein the first set of conditions and second set of conditions differ and wherein the nucleic acid sequence encoding a biocatalyst polypeptide is differentially expressed under the first set of conditions than under the second set of conditions. In embodiments, the host cell produces a fermentation product such as butanol or 2-butanone under at least one of the first set or the second set of conditions.

In embodiments, the first set of conditions and the second set of conditions differ in at least one of source of carbon substrate, dissolved oxygen concentration, temperature, pH, glucose concentration, or fermentation product concentration such as butanol or 2-butanone concentration. In embodiments, the dissolved oxygen concentration is greater during the first set of conditions than during the second set of conditions. In embodiments, one set of conditions is anaerobic. In embodiments, the second set of conditions is anaerobic. In embodiments, the average glucose concentration is lower in the first set of conditions than during the second set of conditions. In embodiments, the average glucose concentration is at least about 5 times lower in the first set of conditions than during the second set of conditions, at least about 50 times lower in the first set of conditions than during the second set of conditions, at least about 100 times lower in the first set of conditions than in the second set of conditions, or at least about 1000 times lower in the first set of conditions than in the second set of conditions. In embodiments, the rate of butanol production is lower under the first set of conditions than under the second set of conditions.

In embodiments, the source of carbon substrate for the first set of conditions differs from that of the second set of conditions. In embodiments, the source of the carbon substrate for the first set of conditions is molasses. In embodiments the source of the carbon substrate for the second set of conditions is corn mash.

Accordingly, heterologous polynucleotides comprising i) a promoter nucleic acid sequences; and ii) a nucleic acid sequence encoding biocatalyst polypeptides are provided herein and may be employed in the disclosed methods.

In embodiments, isolated polynucleotides provided herein comprise: (a) a promoter nucleic acid sequence; and (b) a nucleic acid sequence encoding a biocatalyst polypeptide; wherein the nucleic acid sequence of (b) is operably associated to the nucleic acid sequence of (a) such that the biocatalyst polypeptide is differentially expressed during the production phase and the propagation phase of a fermentation process. In embodiments, the expression of the biocatalyst polypeptide is higher in the production phase than in the propagation phase of fermentation. In embodiments, the biocatalyst polypeptide catalyzes a substrate to product conversion in a butanol or 2-butanone biosynthetic pathway. In embodiments, the biocatalyst polypeptide is selected from a group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.136, EC 4.2.1.17, EC 4.2.1.55, EC 1.3.1.44, EC 1.3.1.38, EC 1.3.1.44, EC 1.3.1.38, EC 5.4.99.13, EC 4.1.1.5, EC 1.1.1.1, 2.7.1.29, 1.1.1.76, 1.2.1.57, and 4.2.1.28. In embodiments, the biocatalyst polypeptide catalyzes a substrate to product conversion in an isobutanol biosynthetic pathway. In embodiments, the biocatalyst polypeptide is acetolactate synthase, acetohydroxy acid isomeroreductase, acetohydroxy acid dehydratase, branched-chain alpha-keto acid decarboxylase, branched-chain alcohol dehydrogenase, branched-chain keto acid dehydrogenase, butyryl-CoA dehydrogenase, butyraldehyde dehydrogenase, transaminase, valine dehydrogenase, valine decarboxylase, omega transaminase, acetyl-CoA acetyltransferase, 3-hydroxybutyryl-CoA dehydrogenase, crotonase, butyryl-CoA dehydrogenase, isobutyryl-CoA mutase, acetolactate decarboxylase, acetonin aminase, butanol dehydrogenase, butyraldehyde dehydrogenase, acetoin kinase, acetoin phosphate aminase, aminobutanol phosphate phospholyase, aminobutanol kinase, butanediol dehydrogenase, or butanediol dehydratase. In embodiments, the biocatalyst polypeptide is a GPI-anchored cell wall protein involved in acid resistance. In embodiments, the biocatalyst polypeptide is Sed1 protein or Spi1 protein or a homolog thereof. The isolated polynucleotide of claim 28, 29, or 31 wherein the biocatalyst polypeptide is a GPI-anchored cell wall protein involved in acid resistance. In embodiments, the biocatalyst polypeptide comprises at least 90% identity to SEQ ID NO: 397, 399, 401, 403, 405, 407, 409, 411, 413, 415, 417, 419, 421, 423, 425, 427, 429, 431, 433, or 435.

In embodiments, a biocatalyst polypeptide may be a biosynthetic pathway polypeptide, a cell integrity polypeptide, a propagation polypeptide, a glycerol biosynthesis pathway polypeptide, by-product producing polypeptide, or an NADPH-generating polypeptide. In embodiments, the biocatalyst polypeptide catalyzes the substrate to product conversion of pyruvate to acetolactate. In embodiments, the biocatalyst polypeptide catalyzes the substrate to product conversion of pyruvate to acetolactate and comprises at least about 85%, at least about 90%, at least about 95%, at least about 99%, or 100% identity to SEQ ID NO: 1 or a variant or active fragment thereof.

In embodiments, the promoter nucleic acid sequence comprises at least about 90%, at least about 95%, at least about 99% or 100% identity to SEQ ID NO: 170, 171, 172, 175, 176, 177, 186, 186, 188, 189, 190, 191, 192, 193, 194, 194, 195, 196, 197, 198, 199, 200, 201, 202, 203, 204, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, or 258 or an active fragment thereof. In embodiments, the promoter nucleic acid sequence comprises at least about 90%, at least about 95%, at least about 99% or 100% identity to SEQ ID NO: 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, or 383 or an active fragment thereof. In embodiments, the promoter nucleic acid sequence comprises at least about 90%, at least about 95%, at least about 99% or 100% identity to SEQ ID NO: 775, 776, 777, or 778 or an active fragment thereof. In embodiments, the promoter nucleic acid sequence comprises at least about 90%, at least about 95%, at least about 99% or 100% identity to SEQ ID NO: 779 or an active fragment thereof. In embodiments, the promoter nucleic acid sequence comprises at least about 90%, at least about 95%, at least about 99% or 100% identity identity to SEQ ID NO: 686. In embodiments, the promoter nucleic acid sequence comprises at least about 90%, at least about 95%, at least about 99% or 100% identity to SEQ ID NO: 384, 360, 386, or 331 or an active fragment thereof. In embodiments, the promoter nucleic acid sequence comprises at least about 90%, at least about 95%, at least about 99% or 100% identity to SEQ ID NO: 772 or 773 or an active fragment thereof. In embodiments, the promoter nucleic acid sequence comprises at least about 90%, at least about 95%, at least about 99% or 100% identity to SEQ ID NO: 779 or an active fragment thereof. In embodiments, the promoter nucleic acid sequence comprises at least about 90%, at least about 95%, at least about 99% or 100% identity to SEQ ID NO: 168, 169, 388, or 173 or an active fragment thereof. In embodiments, the promoter nucleic acid sequence comprises at least about 90%, at least about 95%, at least about 99% or 100% identity to SEQ ID NO: 768 or 769. In embodiments, the promoter nucleic acid sequence comprises at least about 90%, at least about 95%, at least about 99% or 100% identity to SEQ ID NO: 779 or an active fragment thereof. In embodiments, the promoter nucleic acid sequence comprises at least about 90%, at least about 95%, at least about 99% or 100% identity to SEQ ID NO: 711 or an active fragment thereof. In embodiments, the promoter nucleic acid sequence comprises at least about 90%, at least about 95%, at least about 99% or 100% identity to SEQ ID NO: 140, 141, 142, 143, 144, 145, 146, 147, 148, 149, 150, or 151 or a fragment thereof.

In embodiments, the promoter nucleic acid sequence comprises at least about 90% or at least about 95% identity to SEQ ID NO: 140, 141, 142, 143, 144, 145, 146, 147, 148, 149, 150, or 151 or a fragment thereof. In embodiments, the promoter nucleic acid sequence comprises at least about 85%, at least about 90%, at least about 95%, or at least about 99% identity to SEQ ID NO: 168, 169, 170, 171, 172, 173, 174, 175, 176, or 177 or a fragment thereof.

In embodiments, the promoter nucleic acid sequence comprises at least about 85%, at least about 90%, at least about 95%, or at least about 99% to SEQ ID NO: 168, 169, 170, 171, 172, 173, 174, 175, 176, or 177 or a fragment thereof and wherein the biocatalyst polypeptide is acetolactate synthase or ketol-acid reductoisomerase. In embodiments, the acetolactate synthase has at least about 80%, at least about 85%, at least about 90%, at least about 95%, at least about 99% or 100% identity to SEQ ID NO: 1 or a variant or active fragment thereof. In embodiments, the acetolactate synthase is *B. subtilis* AlsS or a variant or active fragment thereof.

In embodiments, the expression of the biocatalyst polypeptide is higher in the propagation phase than in the production phase of fermentation. In embodiments, the biocatalyst polypeptide is a biosynthetic pathway polypeptide or a cell integrity polypeptide. In some embodiments, the biocatalyst polypeptide is a propagation polypeptide, an isobutanol pathway by-product polypeptide, a glycerol biosynthesis pathway, or a polypeptide of an NADPH generating pathway. In some embodiments, the biocatalyst polypeptide is a phosphoketolase. In some embodiments, the phosphoketolase is derived from *Lactobacillus plantarum*. In some embodiments, the biocatalyst polypeptide is a phosphotransacetylase. In some embodiments, the phosphotransacetylase is derived from *Lactobacillus plantarum*. In some embodiments, biocatalyst polypeptide is an acetolactate reductase. In some embodiments, the acetolactate reductase is YMR226C. In some embodiments, the biocatalyst polypeptide is an aldehyde dehydrogenase. In some embodiments, the biocatalyst polypeptide is ALD6. In some embodiments, the biocatalyst polypeptide is an enzyme of the oxidative pentose phosphate pathway. In some embodiments, the biocatalyst polypeptide is glucose-6-phosphate dehydrogenase, 6-phosphoglucononolactonase, or 6-phosphogluconate dehydrogenase. In embodiments, the biocatalyst polypeptide is glycerol 3-phosphate dehydrogenase. In embodiments, the promoter nucleic acid sequence comprises at least about 90% or at least about 95% identity to SEQ ID NO: 152, 153, 154, 155, 156, 157, 158, 159, 160, 161, 162, or 163, or a fragment thereof.

In embodiments, the nucleic acid sequence encoding a biocatalyst polypeptide is codon-optimized for expression in a specific host cell.

Also disclosed herein are recombinant host cells comprising isolated polynucleotides disclosed. In embodiments, the host cell is a bacteria, cyanobacteria, filamentous fungi, or yeast cell. In embodiments, the host cell is a bacterial or cyanobacterial cell. In embodiments, the genus of said host cell is *Salmonella, Arthrobacter, Bacillus, Brevibacterium, Clostridium, Corynebacterium, Gluconobacter, Nocardia, Pseudomonas, Rhodococcus, Streptomyces, Zymomonas, Escherichia, Lactobacillus, Lactococcus, Enterococcus, Alcaligenes, Klebsiella, Paenibacillus*, or *Xanthomonas*. In embodiments, the host cell is a filamentous fungi or yeast cell. In embodiments, the genus of said host cell is *Saccharomyces, Pichia, Hansenula, Yarrowia, Aspergillus, Kluyveromyces, Pachysolen, Rhodotorula, Zygosaccharomyces, Schizosaccharomyces, Torulaspora, Debayomyces, Williopsis, Dekkera, Kloeckera, Metschnikowia, Issatchenkia* or *Candida*. In embodiments, the host cell is *Saccharomyces cerevisiae*. In embodiments, the host cell comprises reduced or eliminated expression of endogenous pyruvate decarboxylase. In embodiments, the reduced or eliminated expression of decarboxylase is caused by gene deletion, disruption, or mutation. In embodiments, the gene disrupted or deleted is PDC1, PDC5, PDC6, or a combination thereof. In some embodiments, the host cell comprises reduced or eliminated expression of an endogenous enzyme having aldehyde dehydrogenase activity, glycerol-3-phosphate dehydrogenase activity, acetolactate reductase activity, or a polypeptide affecting Fe—S cluster biosynthesis. In some embodiments, the reduced or eliminated expression of an endogenous enzyme having aldehyde dehydrogenase activity, glycerol-3-phosphate dehydrogenase activity, acetolactate reductase activity, or a polypeptide affecting Fe—S cluster biosynthesis is caused by gene deletion, disruption, or mutation.

Provided are recombinant yeast host cells comprising an isobutanol biosynthetic pathway and at least one modified expression construct that differentially expresses a polypeptide under conditions in which propagation of biomass is favored over production of isobutanol whereby isobutanol production under said conditions is substantially reduced as compared to a host cell without said modified expression construct under the same conditions. In embodiments, the modified expression construct comprises SEQ ID NO: 711. In embodiments, the modified expression construct comprises a polynucleotide encoding a polypeptide capable of catalyzing the substrate to product conversion pyruvate to acetolactate. In embodiments, the polynucleotide encoding a polypeptide capable of catalyzing the substrate to product conversion pyruvate to acetolactate comprises at least about 85%, at least about 90%, at least about 95% or 100% identity to SEQ ID NO: 2. In embodiments, the polypeptide capable of catalyzing the substrate to product conversion pyruvate to acetolactate comprises at least about 85%, at least about 90%, at least about 95% or 100% identity to SEQ ID NO: 1. In embodiments, the modified expression construct comprises at least about 85%, at least about 90%, at least about 95% or 100% identity to SEQ ID NO: 790. In embodiments, the yeast host cell is *Saccharomyces cerevisiae*.

Also disclosed herein are methods for the production of a fermentation product comprising: (a) providing a disclosed recombinant host cell; (b) contacting said host cell with fermentable carbon substrate in a fermentation medium under conditions whereby the fermentation product is produced; and (c) optionally, recovering said fermentation product.

In embodiments, the methods further comprise propagating said host cell under conditions whereby the host cell propagates prior to the contacting of (b). In embodiments, the conditions whereby the fermentation product are produced are anaerobic. In embodiments, the conditions whereby the fermentation product are produced are microaerobic. In embodiments, the fermentation product is selected from the group consisting of: butanol, 2-butanone, propanol, isopropanol, and ethanol. In embodiments, the fermentation product is butanol or 2-butanone. In embodiments, the fermentation product is isobutanol. In embodiments, the fermentation product is isobutanol and the isolated polynucleotide comprises the promoter nucleic acid sequence comprises at least about 90% or at least about 95% identity to SEQ ID NO: 168, 169, 170, 171, 172, 173, 174, 175, 176, or 177 or a fragment thereof and the biocatalyst polypeptide is acetolactate synthase or ketol-acid reductoisomerase.

Also disclosed herein are methods for screening candidate promoter sequences that are preferentially expressed during the production phase of fermentation, comprising:
  (a) incubating a microorganism under propagation conditions;
  (b) isolating ribonucleic acid molecules from the microorganism incubated in (a);
  (c) incubating a microorganism under production conditions;
  (d) isolating ribonucleic acid molecules from the microorganism incubated in (c);
  (e) selecting only those isolated ribonucleic acid molecules in (d) that are expressed at a higher level than the corresponding isolated ribonucleic acid molecules in (b); and
  (f) determining the polynucleotide sequences of the promoters associated with the expression of the ribonucleic acid molecules selected in (e).

Also disclosed herein are methods for screening candidate promoter sequences that are preferentially inhibited during the production phase of fermentation, comprising:
  (a) incubating a microorganism under propagation conditions;
  (b) isolating ribonucleic acid molecules from the microorganism incubated in (a);
  (c) incubating a microorganism under production conditions;
  (d) isolating ribonucleic acid molecules from the microorganism incubated in (c);
  (e) selecting only those isolated ribonucleic acid molecules in (d) that are expressed at a lower level than the corresponding isolated ribonucleic acid molecules in (b); and
  (f) determining the polynucleotide sequences of the promoters associated with the expression of the ribonucleic acid molecules selected in (e).

Also disclosed herein are methods for screening candidate promoter sequences that are preferentially inhibited during the propagation phase of fermentation, comprising:
  (a) incubating a microorganism under propagation conditions;
  (b) isolating ribonucleic acid molecules from the microorganism incubated in (a);
  (c) incubating a microorganism under production conditions;
  (d) isolating ribonucleic acid molecules from the microorganism incubated in (c);
  (e) selecting only those isolated ribonucleic acid molecules in (d) that are expressed at a higher level than the corresponding isolated ribonucleic acid molecules in (b); and (f) determining the polynucleotide sequences of the promoters associated with the expression of the ribonucleic acid molecules selected in (e).

In embodiments, the ribonucleic acid molecules isolated in (b) and (d) are labeled. In embodiments, the ribonucleic acid molecules isolated in (b) and (d) are operably associated with a polynucleotide encoding a fluorescent protein. In embodiments, the propagation conditions comprise growing the microorganism in fermentation medium comprising a concentration of a fermentable carbon substrate and the production conditions comprise growing the microorganism in fermentation medium comprising a higher concentration of the same fermentable carbon substrate. In embodiments, the fermentable carbon substrate is selected from the group consisting of: monosaccharides, oligosaccharides, polysaccharides and mixtures thereof. In embodiments, the propagation conditions comprise growing the microorganism in fermentation medium comprising a concentration of dissolved oxygen and the production conditions comprise growing the microorganism in fermentation medium comprising a lower concentration of dissolved oxygen. In embodiments, the lower concentration of dissolved oxygen is less than about 3%.

In other embodiments uncoupling growth and production occurs not necessarily from differential expression, but from changing conditions or activity of a cell pathway, protein, or other component by the addition or deletion of another component. The addition, deletion or action of said other component may be combined with differential expression or may result in control over growth and/or production independent of differential expression.

DETAILED DESCRIPTION

Figure 1:
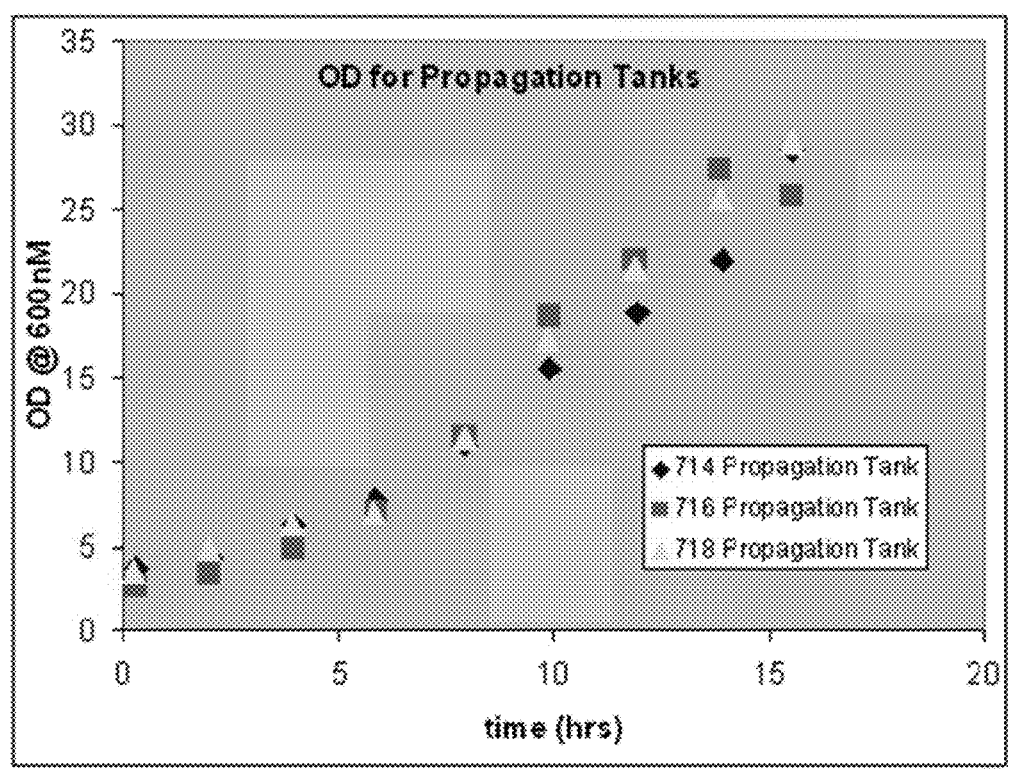
FIG. 1 depicts cell growth and glucose consumption in propagation tanks OD (biomass) is illustrated as a function of fermentation time.

The invention is directed to recombinant host cells that produce fermentation products and comprise promoter sequences that provide differential expression in the propagation vs. production phases of a process, as well as methods for using the same.

Industrial fermentation processes with yeast may employ a stage of biomass production in order to provide sufficient biocatalyst for the fermentation stage to have desired yield and production rate. Ethanologen S. cerevisiae for example is typically propagated using fed-batch technology, in which low sugar concentrations and non-limiting aeration favor respiratory metabolism with high biomass yields, e.g. $Y_{xs}$~0.5 g biomass/g glucose. The maintenance of low sugar concentrations in a fed-batch regime may be particularly important for a Crabtree-positive yeast like S. cerevisiae, in which the fraction of respiratory metabolism on overall metabolism is negatively correlated with increasing extracellular glucose concentrations. Due to the low sugar concentrations, specific glucose uptake rate is limited and respiratory capacity is sufficient to completely metabolize pyruvic acid formed in catabolism of the carbohydrate substrates to $CO_2$. Under fermentative conditions with no oxygen or at higher glucose concentrations under aerobic conditions with the Crabtree effect in action, ethanologen yeasts like e.g. S. cerevisiae produce ethanol and only low biomass yields are achieved, e.g. $Y_{xs}$~0.15 g biomass/g glucose.

Considerations for the propagation of biocatalysts that produce lower alkyl alcohols, such as butanologenic biocatalysts include (i) the negative effect of toxic products, such as butanol or 2-butanone, (ii) the accumulation of inhibitory pathway byproducts or intermediates, and (iii) the loss of substrate to the formation of fermentation byproducts resulting in lower yields of biocatalyst and fermentation product formation. For example, when a butanol production pathway functions constitutively in yeast, then the butanol produced may inhibit growth during the propagation phase of a production process and may add cost and inefficiency to either or both the infrastructure and the operation of the biocatalyst production phase. Control, particularly reduction or elimination, of butanol production during the biomass-forming phase would represent an advance in the art.

Applicants have solved the stated problems by identifying various promoter nucleic acid sequences which provide differential expression of genes of interest under different conditions, thus providing a strategy for differential expression during biocatalyst propagation and fermentation product production phases. Also provided herein is a suitable screening strategy to identify and evaluate candidate nucleic acid sequences to govern the differential expression of genes of interest during biocatalyst propagation and fermentation product production phases. Furthermore, hybrid sequences comprising nucleic acid sequences derived from more than one promoter region are provided. The nucleic acid sequences described herein may be employed as promoters for the expression of various polypeptides relevant to propagation and/or production and are hereinafter referred to from time to time as "genetic switches". The sequences and methods disclosed herein thus allow (i) biocatalyst polypeptides such as polypeptides which catalyze the substrate to product conversions of a biosynthetic pathway such as a butanol or 2-butanone biosynthetic pathway to be preferentially expressed during the production phase of fermentation, (ii) biocatalyst polypeptides beneficial for cell integrity to be preferentially expressed during the production phase of fermentation, (iii) biocatalyst polypeptides such as propagation polypeptides to be preferentially expressed during the biocatalyst propagation phase, (iv) biocatalyst polypeptides being part of a NADPH generating pathway to be preferentially expressed during the propagation phase, or (v) expression of polypeptides being part of a NADH consuming product pathway other than butanol to be preferentially reduced during the fermentation product production phase, or a combination thereof. Applicants have also provided recombinant host cells utilizing recombinant polynucleotide sequences comprising the identified promoters and methods for producing fermentation products using the same.

In embodiments, recombinant host cells described herein produce butanol or 2-butanone from plant derived carbon sources. Accordingly, provided herein are methods for the production of butanol or 2-butanone using recombinant host cells comprising isolated polynucleotides comprising promoter nucleic acid sequences that differentially regulate the expression of associated genes during the propagation and production phases of a fermentation process. In one embodiment, a polypeptide catalyzing the first step in a butanol biosynthetic pathway can be preferentially expressed during the production phase. In one embodiment, a polypeptide catalyzing a substrate to product conversion in an isobutanol biosynthetic pathway can be preferentially expressed during the production phase. In one embodiment, acetolactate synthase can be preferentially expressed during the production phase. In one embodiment, ketol-acid reductoisomerase can be preferentially expressed during the production phase. In one embodiment, dihydroxyacid dehydratase can be preferentially expressed during the production phase.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

A used herein, the terms "comprises," "comprising," "includes," "including," "has," "having," "contains," or "containing," or any other variation thereof, will be understood to imply the inclusion of a stated integer or group of integers but not the exclusion of any other integer or group of integers. For example, a composition, a mixture, a process, a method, an article, or an apparatus that comprises a list of elements not expressly listed or inherent to only those elements but can include other elements not expressly listed or inherent to such composition, mixture, process, method, article, or apparatus. Further, unless expressly stated to the contrary, "or" refers to an inclusive or and not to exclusive or. For example, a condition A or B is satisfied by any one of the following: A is true (or present) and B is false (or not present), A is false (or not present) and B is true (or present), and both A and B are true (or present).

Also, the indefinite articles "a" and "an" preceding an element or component of the invention are intended to be nonrestrictive regarding the number of instances, i.e., occurrences of the element or component. Therefore, "a" or "an" should be read to include one or at least one, and the singular word form of the element or component also includes the plural unless the number is obviously meant to be singular.

The term "invention" or "present invention" as used herein is a non-limiting term and is not intended to refer to any single embodiment of the particular invention but encompasses all possible embodiments as described in the application.

As used herein, the term "about" modifying the quantity of an ingredient or reactant of the invention employed refers to variation in the numerical quantity that can occur, for example, through typical measuring and liquid handling procedures used for making concentrates or solutions in the real world; through inadvertent error in these procedures; through differences in the manufacture, source, or purity of the ingredients employed to make the compositions or to carry out the methods; and the like. The term "about" also encompasses amounts that differ due to different equilibrium conditions for a composition resulting from a particular initial mixture. Whether or not modified by the term "about," the claims include equivalents to the quantities. In one embodiment, the term "about" means within 10% of the reported numerical value, alternatively within 5% of the reported numerical value.

The term "growth phase" or "propagation phase" refers to the process steps during which yeast biomass is produced and inoculum build-up occurs.

The term "production phase" refers to the fermentation process steps during which a desired fermentation product, including, but not limited to butanol, isobutanol, 1-butanol, 2-butanol and/or 2-butanone production, occurs.

In some instances, "biomass" as used herein refers to the cell biomass of the fermentation product-producing microorganism, typically provided in units g/L dry cell weight (dcw).

The term "fermentation product" includes any desired product of interest, including lower alkyl alcohols including, but not limited to butanol, lactic acid, 3-hydroxy-propionic acid, acrylic acid, acetic acid, succinic acid, citric acid, fumaric acid, malic acid, itaconic acid, 1,3-propane-diol, ethylene, glycerol, isobutyrate, etc.

The term "lower alkyl alcohol" refers to any straight-chain or branched, saturated or unsaturated, alcohol molecule with 1-10 carbon atoms.

The term "butanol" refers to 1-butanol, 2-butanol, isobutanol, or mixtures thereof. Isobutanol is also known as 2-methyl-1-propanol.

The term "butanol biosynthetic pathway" as used herein refers to an enzyme pathway to produce 1-butanol, 2-butanol, or isobutanol. For example, isobutanol biosynthetic pathways are disclosed in U.S. Pat. No. 7,851,188, which is incorporated by reference herein. Components of the pathways consist of all substrates, cofactors, byproducts, intermediates, end-products, and enzymes in the pathways.

The term "2-butanone biosynthetic pathway" as used herein refers to an enzyme pathway to produce 2-butanone.

The term "propagation polypeptide" includes polypeptides associated with the production of biomass, and polypeptides associated with the performance of an enzyme that is associated with the production of biomass.

The term "biocatalyst polypeptide" includes polypeptides associated with the substrate to product conversions of an indicated biosynthetic pathway, for example a butanol or 2-butanone biosynthetic pathway, and polypeptides associated with the propagation or performance of a biocatalyst that is associated with the indicated biosynthetic pathway, including, but not limited to, cell integrity polypeptides and propagation polypeptides. For example, a polypeptide that is a part of an NADPH generating pathway or a polypeptide that is part of a non-butanol NADH consuming product pathway may be biocatalyst polypeptides.

The term "biosynthetic pathway polypeptide" includes polypeptides that catalyze substrate to product conversions of a recited biosynthetic pathway.

The term "cell integrity polypeptide" includes polypeptides involved in cell integrity, including polypeptides required for constituting the cellular architecture.

A "recombinant microbial host cell" is defined as a host cell that has been genetically manipulated. In embodiments, recombinant microbial host cells have been genetically manipulated to express a biosynthetic production pathway, wherein the host cell either produces a biosynthetic product in greater quantities relative to an unmodified host cell or produces a biosynthetic product that is not ordinarily produced by an unmodified host cell.

The term "fermentable carbon substrate" refers to a carbon source capable of being metabolized by the microorganisms such as those disclosed herein. Suitable fermentable carbon substrates include, but are not limited to, monosaccharides, such as glucose or fructose; disaccharides, such as lactose or sucrose; oligosaccharides; polysaccharides, such as starch, cellulose, or lignocellulose, hemicellulose; one-carbon substrates, fatty acids; and a combination of these.

"Fermentation medium" as used herein means the mixture of water, sugars (fermentable carbon substrates), dissolved solids, microorganisms producing fermentation products, fermentation product and all other constituents of the material held in the fermentation vessel in which the fermentation product is being made by the reaction of fermentable carbon substrates to fermentation products, water and carbon dioxide ($CO_2$) by the microorganisms present. From time to time, as used herein the term "fermentation broth" and "fermentation mixture" can be used synonymously with "fermentation medium."

The term "aerobic conditions" as used herein means conditions in the presence of oxygen.

The term "microaerobic conditions" as used herein means conditions with low levels of dissolved oxygen. For example, the oxygen level may be less than about 1% of air-saturation.

The term "anaerobic conditions" as used herein means conditions in the absence of oxygen. It will be understood that in many fermentation processes, an initial amount of oxygen is present at the onset of the process, but such oxygen is depleted over the course of the fermentation such that the majority of the process takes place in the absence of detectable oxygen.

As used herein, the term "yield" refers to the amount of product per amount of carbon source in g/g. The yield may be exemplified for glucose as the carbon source. It is understood unless otherwise noted that yield is expressed as a percentage of the theoretical yield. In reference to a microorganism or metabolic pathway, "theoretical yield" is defined as the maximum amount of product that can be generated per total amount of substrate as dictated by the stoichiometry of the metabolic pathway used to make the product. For example, the theoretical yield for one typical conversion of glucose to isopropanol is 0.33 g/g. As such, a yield of isopropanol from glucose of 29.7 g/g would be expressed as 90% of theoretical or 90% theoretical yield. It is understood that while in the present disclosure the yield is exemplified for glucose as a carbon source, the invention can be applied to other carbon sources and the yield may vary depending on the carbon source used. One skilled in the art can calculate yields on various carbon sources.

The terms "acetohydroxyacid synthase," "acetolactate synthase" and "acetolactate synthetase" (abbreviated "ALS", "AlsS", "alsS" and/or "AHAS" herein) are used interchangeably herein to refer to an enzyme that catalyzes the conversion of pyruvate to acetolactate and CO2. Example acetolactate synthases are known by the EC number 2.2.1.6 (Enzyme Nomenclature 1992, Academic Press, San Diego). These enzymes are available from a number of sources, including, but not limited to, Bacillus subtilis (GenBank Nos: CAB07802.1 (SEQ ID NO: 1), Z99122 (SEQ ID NO: 2), NCBI (National Center for Biotechnology Information) amino acid sequence, NCBI nucleotide sequence, respectively), CAB15618 (SEQ ID NO: 789), Klebsiella pneumoniae (GenBank Nos: AAA25079 (SEQ ID NO:3), M73842 (SEQ ID NO:4)), and Lactococcus lactis (GenBank Nos: AAA25161 (SEQ ID NO:5), L16975 (SEQ ID NO:6)).

The term "ketol-acid reductoisomerase" ("KARI"), and "acetohydroxy acid isomeroreductase" will be used interchangeably and refer to enzymes capable of catalyzing the reaction of (S)-acetolactate to 2,3-dihydroxyisovalerate. Example KARI enzymes may be classified as EC number EC 1.1.1.86 (Enzyme Nomenclature 1992, Academic Press, San Diego), and are available from a vast array of microorganisms, including, but not limited to, Escherichia coli (GenBank Nos: NP_418222 (SEQ ID NO: 7), NC_000913 (SEQ ID NO: 8)), Saccharomyces cerevisiae (GenBank Nos: NP_013459 (SEQ ID NO: 9), NC_001144 (SEQ ID NO: 10)), Methanococcus maripaludis (GenBank Nos: CAF30210 (SEQ ID NO: 11), BX957220 (SEQ ID NO: 12)), and Bacillus subtilis (GenBank Nos: CAB14789 (SEQ ID NO: 13), Z99118 (SEQ ID NO: 14)). KARIs include Anaerostipes caccae KARI variants "K9G9", "K9D3", and "K9JB4P" (SEQ ID NOs: 167, 166, and 791 respectively). In some embodiments, KARI utilizes NADH. In some embodiments, KARI utilizes NADPH.

The term "acetohydroxy acid dehydratase" and "dihydroxyacid dehydratase" ("DHAD") refers to an enzyme that catalyzes the conversion of 2,3-dihydroxyisovalerate to α-ketoisovalerate. Example acetohydroxy acid dehydratases are known by the EC number 4.2.1.9. Such enzymes are available from a vast array of microorganisms, including, but not limited to, E. coli (GenBank Nos: YP_026248 (SEQ ID NO: 15), NC_000913 (SEQ ID NO: 16)), S. cerevisiae (GenBank Nos: NP_012550 (SEQ ID NO: 17), NC_001142 (SEQ ID NO: 18)), M. maripaludis (GenBank Nos: CAF29874 (SEQ ID NO: 19), BX957219 (SEQ ID NO: 20)), B. subtilis (GenBank Nos: CAB14105 (SEQ ID NO: 21), Z99115 (SEQ ID NO: 22)), L. lactis, N. crassa, and S. mutans. DHADs include S. mutans variant "12V5" (SEQ ID NO: 792)

The term "branched-chain α-keto acid decarboxylase" or "α-ketoacid decarboxylase" or "α-ketoisovalerate decarboxylase" or "2-ketoisovalerate decarboxylase" ("KIVD") refers to an enzyme that catalyzes the conversion of α-ketoisovalerate to isobutyraldehyde and $CO_2$. Example branched-chain α-keto acid decarboxylases are known by the EC number 4.1.1.72 and are available from a number of sources, including, but not limited to, Lactococcus lactis (GenBank Nos: AAS49166 (SEQ ID NO: 23), AY548760 (SEQ ID NO: 24); CAG34226 (SEQ ID NO: 25), AJ746364 (SEQ ID NO: 26), Salmonella typhimurium (GenBank Nos: NP_461346 (SEQ ID NO: 27), NC_003197 (SEQ ID NO: 28)), Clostridium acetobutylicum (GenBank Nos: NP_149189 (SEQ ID NO: 29), NC_001988 (SEQ ID NO: 30)), M. caseolyticus (SEQ ID NO: 165), and L. grayi (SEQ ID NO: 164).

The term "branched-chain alcohol dehydrogenase" ("ADH") refers to an enzyme that catalyzes the conversion of isobutyraldehyde to isobutanol. Example branched-chain alcohol dehydrogenases are known by the EC number 1.1.1.265, but may also be classified under other alcohol dehydrogenases (specifically, EC 1.1.1.1 or 1.1.1.2). Alcohol dehydrogenases may be NADPH dependent or NADH dependent. Such enzymes are available from a number of sources, including, but not limited to, *S. cerevisiae* (GenBank Nos: NP_010656 (SEQ ID NO: 31), NC_001136 (SEQ ID NO: 32); NP_014051 (SEQ ID NO: 33) NC_001145 (SEQ ID NO: 34)), *E. coli* (GenBank Nos: NP_417484 (SEQ ID NO: 35), NC_000913 (SEQ ID NO: 36)), *C. acetobutylicum* (GenBank Nos: NP_349892 (SEQ ID NO: 37), NC_003030 (SEQ ID NO: 38); NP_349891 (SEQ ID NO: 39), NC_003030 (SEQ ID NO: 40)), *A. xylosoxidans*, and *B. indica*.

The term "butanol dehydrogenase" refers to a polypeptide (or polypeptides) having an enzyme activity that catalyzes the conversion of isobutyraldehyde to isobutanol or the conversion of 2-butanone and 2-butanol. Butanol dehydrogenases are a subset of a broad family of alcohol dehydrogenases. Butanol dehydrogenase may be NAD- or NADP-dependent. The NAD-dependent enzymes are known as EC 1.1.1.1 and are available, for example, from *Rhodococcus ruber* (GenBank Nos: CAD36475, AJ491307). The NADP dependent enzymes are known as EC 1.1.1.2 and are available, for example, from *Pyrococcus furiosus* (GenBank Nos: AAC25556, AF013169). Additionally, a butanol dehydrogenase is available from *Escherichia coli* (GenBank Nos: NP 417484, NC_000913) and a cyclohexanol dehydrogenase is available from *Acinetobacter* sp. (GenBank Nos: AAG10026, AF282240). The term "butanol dehydrogenase" also refers to an enzyme that catalyzes the conversion of butyraldehyde to 1-butanol, using either NADH or NADPH as cofactor. Butanol dehydrogenases are available from, for example, *C. acetobutylicum* (GenBank NOs: NP 149325, NC_001988; note: this enzyme possesses both aldehyde and alcohol dehydrogenase activity); NP 349891, NC_003030; and NP_349892, NC_003030) and *E. coli* (GenBank NOs: NP_417484, NC_000913).

The term "branched-chain keto acid dehydrogenase" refers to an enzyme that catalyzes the conversion of α-ketoisovalerate to isobutyryl-CoA (isobutyryl-coenzyme A), typically using NAD$^+$ (nicotinamide adenine dinucleotide) as an electron acceptor. Example branched-chain keto acid dehydrogenases are known by the EC number 1.2.4.4. Such branched-chain keto acid dehydrogenases are comprised of four subunits and sequences from all subunits are available from a vast array of microorganisms, including, but not limited to, *B. subtilis* (GenBank Nos: CAB14336 (SEQ ID NO: 41), Z99116 (SEQ ID NO: 42); CAB14335 (SEQ ID NO: 43), Z99116 (SEQ ID NO: 44); CAB14334 (SEQ ID NO: 45), Z99116 (SEQ ID NO: 46); and CAB14337 (SEQ ID NO: 47), Z99116 (SEQ ID NO: 48)) and *Pseudomonas putida* (GenBank Nos: AAA65614 (SEQ ID NO: 49), M57613 (SEQ ID NO: 50); AAA65615 (SEQ ID NO: 51), M57613 (SEQ ID NO: 52); AAA65617 (SEQ ID NO: 53), M57613 (SEQ ID NO: 54); and AAA65618 (SEQ ID NO: 55), M57613 (SEQ ID NO: 56)).

The term "acylating aldehyde dehydrogenase" refers to an enzyme that catalyzes the conversion of isobutyryl-CoA to isobutyraldehyde, typically using either NADH or NADPH as an electron donor. Example acylating aldehyde dehydrogenases are known by the EC numbers 1.2.1.10 and 1.2.1.57. Such enzymes are available from multiple sources, including, but not limited to, *Clostridium beijerinckii* (GenBank Nos: AAD31841 (SEQ ID NO: 57), AF157306 (SEQ ID NO: 58)), *C. acetobutylicum* (GenBank Nos: NP 149325 (SEQ ID NO: 59), NC_001988 (SEQ ID NO: 60); NP_149199 (SEQ ID NO: 61), NC_001988 (SEQ ID NO: 62)), *P. putida* (GenBank Nos: AAA89106 (SEQ ID NO: 63), U13232 (SEQ ID NO: 64)), and *Thermus thermophilus* (GenBank Nos: YP_145486 (SEQ ID NO: 65), NC_006461 (SEQ ID NO: 66)).

The term "transaminase" refers to an enzyme that catalyzes the conversion of α-ketoisovalerate to L-valine, using either alanine or glutamate as an amine donor. Example transaminases are known by the EC numbers 2.6.1.42 and 2.6.1.66. Such enzymes are available from a number of sources. Examples of sources for alanine-dependent enzymes include, but are not limited to, *E. coli* (GenBank Nos: YP_026231 (SEQ ID NO: 67), NC_000913 (SEQ ID NO: 68)) and *Bacillus licheniformis* (GenBank Nos: YP_093743 (SEQ ID NO: 69), NC_006322 (SEQ ID NO: 70)). Examples of sources for glutamate-dependent enzymes include, but are not limited to, *E. coli* (GenBank Nos: YP_026247 (SEQ ID NO: 71), NC_000913 (SEQ ID NO: 72)), *S. cerevisiae* (GenBank Nos: NP_012682 (SEQ ID NO: 73), NC_001142 (SEQ ID NO: 74)) and *Methanobacterium thermoautotrophicum* (GenBank Nos: NP_276546 (SEQ ID NO: 75), NC_000916 (SEQ ID NO: 76)).

The term "valine dehydrogenase" refers to an enzyme that catalyzes the conversion of α-ketoisovalerate to L-valine, typically using NAD(P)H as an electron donor and ammonia as an amine donor. Example valine dehydrogenases are known by the EC numbers 1.4.1.8 and 1.4.1.9 and such enzymes are available from a number of sources, including, but not limited to, *Streptomyces coelicolor* (GenBank Nos: NP_628270 (SEQ ID NO: 77), NC_003888 (SEQ ID NO: 78)) and *B. subtilis* (GenBank Nos: CAB14339 (SEQ ID NO: 79), Z99116 (SEQ ID NO: 80)).

The term "valine decarboxylase" refers to an enzyme that catalyzes the conversion of L-valine to isobutylamine and $CO_2$. Example valine decarboxylases are known by the EC number 4.1.1.14. Such enzymes are found in *Streptomyces*, such as for example, *Streptomyces viridifaciens* (GenBank Nos: AAN10242 (SEQ ID NO: 81), AY116644 (SEQ ID NO: 82)).

The term "omega transaminase" refers to an enzyme that catalyzes the conversion of isobutylamine to isobutyraldehyde using a suitable amino acid as an amine donor. Example omega transaminases are known by the EC number 2.6.1.18 and are available from a number of sources, including, but not limited to, *Alcaligenes denitrificans* (AAP92672 (SEQ ID NO: 83), AY330220 (SEQ ID NO: 84)), *Ralstonia eutropha* (GenBank Nos: YP_294474 (SEQ ID NO: 85), NC_007347 (SEQ ID NO: 86)), *Shewanella oneidensis* (GenBank Nos: NP_719046 (SEQ ID NO: 87), NC_004347 (SEQ ID NO: 88)), and *P. putida* (GenBank Nos: AAN66223 (SEQ ID NO: 89), AE016776 (SEQ ID NO: 90)).

The term "acetyl-CoA acetyltransferase" refers to an enzyme that catalyzes the conversion of two molecules of acetyl-CoA to acetoacetyl-CoA and coenzyme A (CoA). Example acetyl-CoA acetyltransferases are acetyl-CoA acetyltransferases with substrate preferences (reaction in the forward direction) for a short chain acyl-CoA and acetyl-CoA and are classified as E.C. 2.3.1.9 [Enzyme Nomenclature 1992, Academic Press, San Diego]; although, enzymes with a broader substrate range (E.C. 2.3.1.16) will be functional as well. Acetyl-CoA acetyltransferases are available from a number of sources, for example, *Escherichia coli* (GenBank Nos: NP 416728 (SEQ ID NO: 91), NC_000913 (SEQ ID NO: 92); NCBI (National Center for Biotechnology Information) amino acid sequence, NCBI nucleotide sequence), *Clostridium acetobutylicum* (GenBank Nos: NP 349476.1

(SEQ ID NO: 93), NC_003030 (SEQ ID NO: 94); NP 149242 (SEQ ID NO: 95), NC_001988 (SEQ ID NO: 96), *Bacillus subtilis* (GenBank Nos: NP 390297 (SEQ ID NO: 97), NC_000964 (SEQ ID NO: 98)), and *Saccharomyces cerevisiae* (GenBank Nos: NP_015297 (SEQ ID NO: 99), NC_001148 (SEQ ID NO: 100)).

The term "3-hydroxybutyryl-CoA dehydrogenase" refers to an enzyme that catalyzes the conversion of acetoacetyl-CoA to 3-hydroxybutyryl-CoA. 3-Example hydroxybutyryl-CoA dehydrogenases may be reduced nicotinamide adenine dinucleotide (NADH)-dependent, with a substrate preference for (S)-3-hydroxybutyryl-CoA or (R)-3-hydroxybutyryl-CoA. Examples may be classified as E.C. 1.1.1.35 and E.C. 1.1.1.30, respectively. Additionally, 3-hydroxybutyryl-CoA dehydrogenases may be reduced nicotinamide adenine dinucleotide phosphate (NADPH)-dependent, with a substrate preference for (S)-3-hydroxybutyryl-CoA or (R)-3-hydroxybutyryl-CoA and are classified as E.C. 1.1.1.157 and E.C. 1.1.1.36, respectively. 3-Hydroxybutyryl-CoA dehydrogenases are available from a number of sources, for example, *C. acetobutylicum* (GenBank NOs: NP_349314 (SEQ ID NO: 101), NC_003030 (SEQ ID NO: 102)), *B. subtilis* (GenBank NOs: AAB09614 (SEQ ID NO: 103), U29084 (SEQ ID NO: 104)), *Ralstonia eutropha* (GenBank NOs: YP_294481 (SEQ ID NO: 105), NC_007347 (SEQ ID NO: 106)), and *Alcaligenes eutrophus* (GenBank NOs: AAA21973 (SEQ ID NO: 107), J04987 (SEQ ID NO: 108)).

The term "crotonase" refers to an enzyme that catalyzes the conversion of 3-hydroxybutyryl-CoA to crotonyl-CoA and $H_2O$. Example crotonases may have a substrate preference for (S)-3-hydroxybutyryl-CoA or (R)-3-hydroxybutyryl-CoA and may be classified as E.C. 4.2.1.17 and E.C. 4.2.1.55, respectively. Crotonases are available from a number of sources, for example, *E. coli* (GenBank NOs: NP_415911 (SEQ ID NO: 109), NC_000913 (SEQ ID NO: 110)), *C. acetobutylicum* (GenBank NOs: NP 349318 (SEQ ID NO: 111), NC_003030 (SEQ ID NO: 112)), *B. subtilis* (GenBank NOs: CAB13705 (SEQ ID NO: 113), Z99113 (SEQ ID NO: 114)), and *Aeromonas caviae* (GenBank NOs: BAA21816 (SEQ ID NO: 115), D88825 (SEQ ID NO: 116)).

The term "butyryl-CoA dehydrogenase" refers to an enzyme that catalyzes the conversion of crotonyl-CoA to butyryl-CoA. Example butyryl-CoA dehydrogenases may be NADH-dependent, NADPH-dependent, or flavin-dependent and may be classified as E.C. 1.3.1.44, E.C. 1.3.1.38, and E.C. 1.3.99.2, respectively. Butyryl-CoA dehydrogenases are available from a number of sources, for example, *C. acetobutylicum* (GenBank NOs: NP_347102 (SEQ ID NO: 117), NC_003030 (SEQ ID NO: 118))), *Euglena gracilis* (GenBank NOs: Q5EU90 SEQ ID NO: 119), AY741582 SEQ ID NO: 120)), *Streptomyces collinus* (GenBank NOs: AAA92890 (SEQ ID NO: 121), U37135 (SEQ ID NO: 122)), and *Streptomyces coelicolor* (GenBank NOs: CAA22721 (SEQ ID NO: 123), AL939127 (SEQ ID NO: 124)).

The term "isobutyryl-CoA mutase" refers to an enzyme that catalyzes the conversion of butyryl-CoA to isobutyryl-CoA. This enzyme uses coenzyme $B_{12}$ as cofactor. Example isobutyryl-CoA mutases are known by the EC number 5.4.99.13. These enzymes are found in a number of *Streptomyces*, including, but not limited to, *Streptomyces cinnamonensis* (GenBank Nos: AAC08713 (SEQ ID NO: 125), U67612 (SEQ ID NO: 126); CAB59633 (SEQ ID NO: 127), AJ246005 (SEQ ID NO: 128)), *S. coelicolor* (GenBank Nos: CAB70645 (SEQ ID NO: 129), AL939123 (SEQ ID NO: 130); CAB92663 (SEQ ID NO: 131), AL939121 (SEQ ID NO: 132)), and *Streptomyces avermitilis* (GenBank Nos: NP 824008 (SEQ ID NO: 133), NC_003155 (SEQ ID NO: 134); NP_824637 (SEQ ID NO: 135), NC_003155 (SEQ ID NO: 136)).

The term "butyraldehyde dehydrogenase" refers to an enzyme that catalyzes the conversion of butyryl-CoA to butyraldehyde, using NADH or NADPH as cofactor. Butyraldehyde dehydrogenases with a preference for NADH are known as E.C. 1.2.1.57 and are available from, for example, *Clostridium beijerinckii* (GenBank NOs: AAD31841, AF157306) and *C. acetobutylicum* (GenBank NOs: NP 149325, NC_001988).

The term "acetolactate decarboxylase" refers to a polypeptide (or polypeptides) having an enzyme activity that catalyzes the conversion of alpha-acetolactate to acetoin. Example acetolactate decarboxylases are known as EC 4.1.1.5 and are available, for example, from *Bacillus subtilis* (GenBank Nos: AAA22223, L04470), *Klebsiella terrigena* (GenBank Nos: AAA25054, L04507) and *Klebsiella pneumoniae* (GenBank Nos: AAU43774, AY722056).

The term "acetoin aminase" or "acetoin transaminase" refers to a polypeptide (or polypeptides) having an enzyme activity that catalyzes the conversion of acetoin to 3-amino-2-butanol. Acetoin aminase may utilize the cofactor pyridoxal 5'-phosphate or NADH (reduced nicotinamide adenine dinucleotide) or NADPH (reduced nicotinamide adenine dinucleotide phosphate). The resulting product may have (R) or (S) stereochemistry at the 3-position. The pyridoxal phosphate-dependent enzyme may use an amino acid such as alanine or glutamate as the amino donor. The NADH- and NADPH-dependent enzymes may use ammonia as a second substrate. A suitable example of an NADH dependent acetoin aminase, also known as amino alcohol dehydrogenase, is described by Ito et al. (U.S. Pat. No. 6,432,688). An example of a pyridoxal-dependent acetoin aminase is the amine:pyruvate aminotransferase (also called amine:pyruvate transaminase) described by Shin and Kim (*J. Org. Chem.* 67:2848-2853 (2002)).

The term "acetoin kinase" refers to a polypeptide (or polypeptides) having an enzyme activity that catalyzes the conversion of acetoin to phosphoacetoin. Acetoin kinase may utilize ATP (adenosine triphosphate) or phosphoenolpyruvate as the phosphate donor in the reaction. Enzymes that catalyze the analogous reaction on the similar substrate dihydroxyacetone, for example, include enzymes known as EC 2.7.1.29 (Garcia-Alles et al. (2004) Biochemistry 43:13037-13046). The term "acetoin phosphate aminase" refers to a polypeptide (or polypeptides) having an enzyme activity that catalyzes the conversion of phosphoacetoin to 3-amino-2-butanol O-phosphate. Acetoin phosphate aminase may use the cofactor pyridoxal 5'-phosphate, NADH or NADPH. The resulting product may have (R) or (S) stereochemistry at the 3-position. The pyridoxal phosphate-dependent enzyme may use an amino acid such as alanine or glutamate. The NADH and NADPH-dependent enzymes may use ammonia as a second substrate. Although there are no reports of enzymes catalyzing this reaction on phosphoacetoin, there is a pyridoxal phosphate-dependent enzyme that is proposed to carry out the analogous reaction on the similar substrate serinol phosphate (Yasuta et al. (2001) Appl. Environ. Microbial. 67:4999-5009 The term "aminobutanol phosphate phospholyase", also called "amino alcohol O-phosphate lyase", refers to a polypeptide (or polypeptides) having an enzyme activity that catalyzes the conversion of 3-amino-2-butanol O-phosphate to 2-butanone. Amino butanol phosphate phospho-lyase may utilize the cofactor pyridoxal 5'-phosphate. There are reports of enzymes that catalyze the analogous reaction on the similar substrate 1-amino-2-propanol phosphate (Jones et al. (1973)

Biochem J. 134:167-182). U.S. Appl. Pub. No. 2007/0259410 describes an aminobutanol phosphate phospho-lyase from the organism *Erwinia carotovora*.

The term "aminobutanol kinase" refers to a polypeptide (or polypeptides) having an enzyme activity that catalyzes the conversion of 3-amino-2-butanol to 3-amino-2butanol O-phosphate. Amino butanol kinase may utilize ATP as the phosphate donor. Although there are no reports of enzymes catalyzing this reaction on 3-amino-2-butanol, there are reports of enzymes that catalyze the analogous reaction on the similar substrates ethanolamine and 1-amino-2-propanol (Jones et al., supra). U.S. Appl. Pub. No. 2009/0155870 describes, in Example 14, an amino alcohol kinase of *Erwinia carotovora* subsp. *Atroseptica*.

The term "butanediol dehydrogenase" also known as "acetoin reductase" refers to a polypeptide (or polypeptides) having an enzyme activity that catalyzes the conversion of acetoin to 2,3-butanediol. Butanedial dehydrogenases are a subset of the broad family of alcohol dehydrogenases. Butanediol dehydrogenase enzymes may have specificity for production of (R)- or (S)-stereochemistry in the alcohol product. (S)-specific butanediol dehydrogenases are known as EC 1.1.1.76 and are available, for example, from *Klebsiella pneumoniae* (GenBank Nos: BBA13085, D86412). (R)-specific butanediol dehydrogenases are known as EC 1.1.1.4 and are available, for example, from *Bacillus cereus* (GenBank Nos. NP 830481, NC_004722; AAP07682, AE017000), and *Lactococcus lactis* (GenBank Nos. AAK04995, AE006323).

The term "butanediol dehydratase", also known as "dial dehydratase" or "propanediol dehydratase" refers to a polypeptide (or polypeptides) having an enzyme activity that catalyzes the conversion of 2,3-butanediol to 2-butanone. Butanediol dehydratase may utilize the cofactor adenosyl cobalamin (also known as coenzyme Bw or vitamin B12; although vitamin B12 may refer also to other forms of cobalamin that are not coenzyme B12). Adenosyl cobalamin-dependent enzymes are known as EC 4.2.1.28 and are available, for example, from *Klebsiella oxytoca* (GenBank Nos: AAO8099 (alpha subunit), D45071; BAA08100 (beta subunit), D45071; and BBA08101 (gamma subunit), D45071 (Note all three subunits are required for activity)], and *Klebsiella pneumonia* (GenBank Nos: AAC98384 (alpha subunit), AF102064; GenBank Nos: AAC98385 (beta subunit), AF102064, GenBank Nos: AAC98386 (gamma subunit), AF102064). Other suitable dial dehydratases include, but are not limited to, B12-dependent dial dehydratases available from *Salmonella typhimurium* (GenBank Nos: AAB84102 (large subunit), AF026270; GenBank Nos: AAB84103 (medium subunit), AF026270; GenBank Nos: AAB84104 (small subunit), AF026270); and *Lactobacillus collinoides* (GenBank Nos: CAC82541 (large subunit), AJ297723; GenBank Nos: CAC82542 (medium subunit); AJ297723; GenBank Nos: CAD01091 (small subunit), AJ297723); and enzymes from *Lactobacillus brevis* (particularly strains CNRZ 734 and CNRZ 735, Speranza et al., J. Agric. Food Chem. (1997) 45:3476-3480), and nucleotide sequences that encode the corresponding enzymes. Methods of dial dehydratase gene isolation are well known in the art (e.g., U.S. Pat. No. 5,686, 276).

The term "pyruvate decarboxylase" refers to an enzyme that catalyzes the decarboxylation of pyruvic acid to acetaldehyde and carbon dioxide. Pyruvate dehydrogenases are known by the EC number 4.1.1.1. These enzymes are found in a number of yeast, including *Saccharomyces cerevisiae* (GenBank Nos: CAA97575 (SEQ ID NO: 137), CAA97705 (SEQ ID NO: 138), CAA97091 (SEQ ID NO: 139)).

The term "phosphoketolase" refers to an enzyme that catalyzes the conversion of xyulose 5-phosphate to glyceraldehyde 3-phosphate and acetyl phosphate. Example phosphoketolases are known by the EC number 4.1.2.9. In some embodiments, the phosphoketolase is xpk from *Lactobacillus plantarum* (nucleic acid SEQ ID NO: 180; amino acid SEQ ID NO: 181).

The term "phosphotransacetylase" refers to an enzyme that catalyzes the conversion of acetyl-CoA and phosphate to CoA and acetyl phosphate. Example phosphotransacetylases are known by the EC number 2.3.1.8. In some embodiments, the phosphotransacetylase is eutD from *Lactobacillus plantarum* (nucleic acid SEQ ID NO: 178; amino acid SEQ ID NO: 179).

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" may be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. In embodiments, the polypeptides provided herein, including, but not limited to biosynthetic pathway polypeptides, cell integrity polypeptides, propagation polypeptides, and other enzymes comprise full-length polypeptides and active fragments thereof.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for the purposes of the invention, as are native or recombinant polypeptides which have been separated, fractionated, or partially or substantially purified by any suitable technique.

A polypeptide of the invention may be of a size of about 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Also included as polypeptides of the present invention are derivatives, analogs, or variants of the foregoing polypeptides, and any combination thereof. The terms "active variant," "active fragment," "active derivative," and "analog" refer to polypeptides of the present invention and include any polypeptides that are capable of catalyzing the indicated substrate to product conversion. Variants of polypeptides of the present invention include polypeptides with altered amino acid sequences due to amino acid substitutions, deletions, and/or insertions. Variants may occur naturally or be non-naturally occurring. Non-naturally occurring variants may be produced using art-known mutagenesis techniques. Variant polypeptides may comprise conservative or non-conservative amino acid substitutions, deletions and/or additions. Derivatives of polypeptides of the present invention, are polypeptides which have been altered so as to exhibit additional features not found on the native polypeptide. Examples include fusion proteins. Variant polypeptides may also be referred to herein as "polypeptide analogs." As used herein a "derivative" of a polypeptide refers to a subject polypeptide having one or more residues chemically derivatized by reaction of a functional side group. Also included as "derivatives" are those peptides which contain one or more naturally occurring amino acid derivatives of the twenty standard amino acids. For example, 4-hydroxyproline may be substituted for proline; 5-hydroxylysine may be substituted for lysine; 3-methylhistidine may be substituted for histidine; homoserine may be substituted for serine; and ornithine may be substituted for lysine.

A "fragment" is a unique portion of polypeptide used in the invention which is identical in sequence to but shorter in length than the parent full-length sequence. A fragment may comprise up to the entire length of the defined sequence, minus one amino acid residue. For example, a fragment may comprise from 5 to 1000 contiguous amino acid residues. A fragment may be at least 5, 10, 15, 16, 20, 25, 30, 40, 50, 60, 75, 100, 150, 250 or at least 500 contiguous amino acid residues in length. Fragments may be preferentially selected from certain regions of a molecule. For example, a polypeptide fragment may comprise a certain length of contiguous amino acids selected from the first 100 or 200 amino acids of a polypeptide as shown in a certain defined sequence. Clearly these lengths are exemplary, and any length that is supported by the specification, including the Sequence Listing, tables, and figures, may be encompassed by the present embodiments. Similarly, "active fragment", when used in reference to a polypeptide, is a portion of a polypeptide which retains the functionality of the subject polypeptide, but comprises less than the entire sequence of the polypeptide.

Alternatively, recombinant variants encoding these same or similar polypeptides can be synthesized or selected by making use of the "redundancy" in the genetic code. Various codon substitutions, such as the silent changes which produce various restriction sites, may be introduced to optimize cloning into a plasmid or viral vector or expression in a host cell system.

Preferably, amino acid "substitutions" are the result of replacing one amino acid with another amino acid having similar structural and/or chemical properties, i.e., conservative amino acid replacements, or they can be result of replacing one amino acid with an amino acid having different structural and/or chemical properties, i.e., non-conservative amino acid replacements. "Conservative" amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" are preferably in the range of about 1 to about 20 amino acids, more preferably 1 to 10 amino acids. The variation allowed may be experimentally determined by systematically making insertions, deletions, or substitutions of amino acids in a polypeptide molecule using recombinant DNA techniques and assaying the resulting recombinant variants for activity.

Polypeptides suitable for use in the present invention and fragments thereof are encoded by polynucleotides. The term "polynucleotide" is intended to encompass a singular nucleic acid as well as plural nucleic acids, and refers to an isolated nucleic acid molecule or construct, e.g., messenger RNA (mRNA), virally-derived RNA, or plasmid DNA (pDNA). A polynucleotide may comprise a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. Polynucleotides according to the present invention further include such molecules produced synthetically. Polynucleotides of the invention may be native to the host cell or heterologous. In addition, a polynucleotide or a nucleic acid may be or may include a regulatory element such as a promoter, ribosome binding site, or a transcription terminator.

A polynucleotide sequence can be referred to as "isolated," in which it has been removed from its native environment. For example, a heterologous polynucleotide encoding a polypeptide or polypeptide fragment having enzymatic activity (e.g., the ability to convert a substrate to xylulose) contained in a vector is considered isolated for the purposes of the present invention. Further examples of an isolated polynucleotide include recombinant polynucleotides maintained in heterologous host cells or purified (partially or substantially) polynucleotides in solution. Isolated polynucleotides or nucleic acids according to the present invention further include such molecules produced synthetically. An isolated polynucleotide fragment in the form of a polymer of DNA can be comprised of one or more segments of cDNA, genomic DNA, or synthetic DNA.

The term "gene" refers to a nucleic acid fragment that is capable of being expressed as a specific protein, optionally including regulatory sequences preceding (5' non-coding sequences) and following (3' non-coding sequences) the coding sequence.

As used herein, a "coding region" or "ORF" is a portion of nucleic acid which consists of codons translated into amino acids. Although a "stop codon" (TAG, TGA, or TAA) is not translated into an amino acid, it may be considered to be part of a coding region, if present, but any flanking sequences, for example promoters, ribosome binding sites, transcriptional terminators, introns, 5' and 3' non-translated regions, and the like, are not part of a coding region. "Suitable regulatory sequences" refer to nucleotide sequences located upstream (5' non-coding sequences), within, or downstream (3' non-coding sequences) of a coding sequence that influence the transcription, RNA processing or stability, or translation of the associated coding sequence. Regulatory sequences can include promoters, translation leader sequences, introns, polyadenylation recognition sequences, RNA processing sites, effector binding sites and stem-loop structures.

The term "promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters which cause a gene to be expressed in most cell types at most times are commonly referred to as "constitutive promoters." It is further recognized that since in most cases the exact boundaries of regulatory sequences have not been completely defined, DNA fragments of different lengths may have identical promoter activity.

Some promoter nucleic acid sequences disclosed herein, including those in Tables 1, 2, 7, and 8, were arbitrarily taken to be 1000 bp 5' of the start codon of each gene. However, the sequences may be retrieved from publicly available databases such as the Yeastract database or the *Saccharomyces* Genome Database. The gene name (where available) and the systematic name (cf. *Saccharomyces* Genome Database where available) is indicated. As described above, it will be appreciated by one of ordinary skill in the art that fragments of different lengths of the sequences provided may have identical promoter activity, thus, reference to, for example "HEM13 promoter", will be understood to encompass a sequence provided herein or any fragment of the promoter region of the HEM13 gene which has identical promoter activity or a substantially similar effect on expression of a target polypeptide or production of an indicated product. Thus, the disclosed nucleic acid sequences should not be construed as limited solely to the provided sequence.

In certain embodiments, the polynucleotide or nucleic acid is DNA. In the case of DNA, a polynucleotide comprising a nucleic acid, which encodes a polypeptide normally may include a promoter and/or other transcription or translation control elements operably associated with one or more coding regions. An operable association is when a coding region for a gene product, e.g., a polypeptide, is associated with one or more regulatory sequences in such a way as to place expression of the gene product under the influence or control of the regulatory sequence(s). Two DNA fragments (such as a polypeptide coding region and a promoter associated therewith) are "operably associated" or "operably linked" or "coupled" if induction of promoter function results in the transcription of mRNA encoding the desired gene product and if the nature of the linkage between the two DNA fragments does not interfere with the ability of the expression regulatory sequences to direct the expression of the gene product or interfere with the ability of the DNA template to be transcribed. Thus, a promoter region would be operably associated with a nucleic acid encoding a polypeptide if the promoter was capable of effecting transcription of that nucleic acid. Other transcription control elements, besides a promoter, for example enhancers, operators, repressors, and transcription termination signals, can be operably associated with the polynucleotide. Suitable promoters and other transcription control regions are disclosed herein. An "expression construct", as used herein, comprises a promoter nucleic acid sequence operably linked to a coding region for a polypeptide and, optionally, a terminator nucleic acid sequence.

A variety of translation control elements are known to those of ordinary skill in the art. These include, but are not limited to ribosome binding sites, translation initiation and termination codons, and elements derived from viral systems (particularly an internal ribosome entry site, or IRES). In other embodiments, a polynucleotide of the present invention is RNA, for example, in the form of messenger RNA (mRNA). RNA of the present invention may be single stranded or double stranded.

Polynucleotide and nucleic acid coding regions of the present invention may be associated with additional coding regions which encode secretory or signal peptides, which direct the secretion of a polypeptide encoded by a polynucleotide of the present invention.

As used herein, the term "transformation" refers to the transfer of a nucleic acid fragment into the genome of a host organism, resulting in genetically stable inheritance. Host organisms containing the transformed nucleic acid fragments are referred to as "recombinant" or "transformed" organisms.

The term "expression," and "expressed" as used herein, refers to the transcription and stable accumulation of sense (mRNA) or antisense RNA derived from the nucleic acid fragment of the invention. Expression may also refer to translation of mRNA into a polypeptide. "Differentially expressed" refers to the differential production of the mRNA transcribed from the gene or the protein product encoded by the gene depending on the environment of the host cell. A differentially expressed gene may be overexpressed or underexpressed as compared to the expression level under other conditions. In one aspect, it refers to a differential that is 1, 2, 3, 4, 5, 10, or 20 times higher or lower than the expression level detected in a reference environment. The term "differentially expressed" also refers to nucleotide sequences in a cell which are expressed where silent or not expressed in a control environment or not expressed where expressed in a control cell.

The terms "plasmid," "vector," refer to an extra chromosomal element often carrying genes which are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific construct containing a gene and having elements in addition to the gene that allow for expression of that gene.

As used herein, "native" refers to the form of a polynucleotide, gene, or polypeptide as found in nature with its own regulatory sequences, if present.

As used herein, "endogenous" refers to the native form of a polynucleotide, gene or polypeptide in its natural location in the organism or in the genome of an organism. "Endogenous polynucleotide" includes a native polynucleotide in its natural location in the genome of an organism. "Endogenous gene" includes a native gene in its natural location in the genome of an organism. "Endogenous polypeptide" includes a native polypeptide in its natural location in the organism.

As used herein, "heterologous" refers to a polynucleotide, gene, or polypeptide not normally found in the host organism but that is introduced into the host organism. "Heterologous polynucleotide" may include a native coding region, or portion thereof, that is reintroduced into the source organism in a form that is different from the corresponding native polynucleotide. "Heterologous gene" includes a native coding region, or portion thereof, that is reintroduced into the source organism in a form that is different from the corresponding native gene. For example, a heterologous gene can include a native coding region that is a portion of a chimeric gene including non-native regulatory regions that is reintroduced into the native host. "Heterologous polypeptide" includes a native polypeptide that is reintroduced into the source organism in a form that is different from the corresponding native polypeptide.

By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence.

As a practical matter, whether any particular nucleic acid molecule or polypeptide is at least 80%, 85%, 90%, 95%, 96%, 97%, 98%, or 99% identical to a nucleotide sequence or polypeptide sequence of the present invention can be determined conventionally using known computer programs. A preferred method for determining the best overall match between a query sequence (a sequence of the present invention) and a subject sequence, also referred to as a global sequence alignment, can be determined using the FASTDB computer program based on the algorithm of Brutlag et al., *Comp. Appl. Biosci.* 6:237-245 (1990). In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty-30, Randomization Group Length=0, Cutoff Score=1, Gap Penalty=5, Gap Size Penalty=0.05, Window Size=500 or the length of the subject nucleotide sequences, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to be made for the purposes of the present invention.

Polypeptides used in the invention are encoded by nucleic acid sequences that are at least about 80%, 85%, 90%, 95%, 96%, 97%, 98%, 99%, or 100% identical to the nucleotide sequences described elsewhere in the specification, including active variants, fragments or derivatives thereof.

The terms "active variant," "active fragment," "active derivative," and "analog" refer to polynucleotides of the present invention and include any polynucleotides that encode biocatalyst polypeptides used in the invention that retain their respective enzymatic activities or structure. Variants of polynucleotides of the present invention include polynucleotides with altered nucleotide sequences due to base pair substitutions, deletions, and/or insertions. Variants may occur naturally or be non-naturally occurring. Non-naturally occurring variants may be produced using art-known mutagenesis techniques. Derivatives of polynucleotides of the present invention, are polynucleotides which have been altered so that the polypeptides they encode exhibit additional features not found on the native polypeptide. Examples include polynucleotides that encode fusion proteins. Variant polynucleotides may also be referred to herein as "polynucleotide analogs." As used herein a "derivative" of a polynucleotide refers to a subject polynucleotide having one or more nucleotides chemically derivatized by reaction of a functional side group. Also included as "derivatives" are those polynucleotides which contain one or more naturally occurring nucleotide derivatives. For example, 3-methylcytidine may be substituted for cytosine; ribothymidine may be substituted for thymidine; and N4-acetylcytidine may be substituted for cytosine.

A "fragment" when used in reference to a promoter sequence is a unique portion of the promoter nucleic acid sequence or the nucleic acid sequence encoding the biocatalyst polypeptide used in the invention which is identical in sequence to but shorter in length than the parent nucleic acid sequence. For example, a fragment may comprise from 5 to 1000 contiguous nucleotides. A fragment used as a probe, primer, or for other purposes, may be at least 5, 10, 15, 16, 20, 25, 30, 40, 50, 60, 75, 100, 150, 250 or at least 500 contiguous nucleotides. A fragment may comprise up to the entire length of the defined sequence, minus one nucleotide or amino acid. Fragments may be preferentially selected from certain regions of a molecule. For example, a polynucleotide fragment may comprise a certain length of contiguous nucleotides selected from the first 100 or 200 nucleotides of a polynucleotide as shown in a certain defined sequence. Clearly these lengths are exemplary, and any length that is supported by the specification, including the Sequence Listing, tables, and figures, may be encompassed by the present embodiments.

As used herein the term "codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

As used herein the term "codon optimized coding region" means a nucleic acid coding region that has been adapted for expression in the cells of a given organism by replacing at least one, or more than one, or a significant number, of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table A. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE A

The Standard Genetic Code

|   | T | C | A | G |
|---|---|---|---|---|
| T | TTT Phe (F) | TCT Ser (S) | TAT Tyr (Y) | TGT Cys (C) |
|   | TTC Phe (F) | TCC Ser (S) | TAC Tyr (Y) | TGC |
|   | TTA Leu (L) | TCA Ser (S) | TAA Ter | TGA Ter |
|   | TTG Leu (L) | TCG Ser (S) | TAG Ter | TGG Trp (W) |
| C | CTT Leu (L) | CCT Pro (P) | CAT His (H) | CGT Arg (R) |
|   | CTC Leu (L) | CCC Pro (P) | CAC His (H) | CGC Arg (R) |
|   | CTA Leu (L) | CCA Pro (P) | CAA Gln (Q) | CGA Arg (R) |
|   | CTG Leu (L) | CCG Pro (P) | CAG Gln (Q) | CGG Arg (R) |
| A | ATT Ile (I) | ACT Thr (T) | AAT Asn (N) | AGT Ser (S) |
|   | ATC Ile (I) | ACC Thr (T) | AAC Asn (N) | AGC Ser (S) |
|   | ATA Ile (I) | ACA Thr (T) | AAA Lys (K) | AGA Arg (R) |
|   | ATG Met (M) | ACG Thr (T) | AAG Lys (K) | AGG Arg (R) |
| G | GTT Val (V) | GCT Ala (A) | GAT Asp (D) | GGT Gly (G) |
|   | GTC Val (V) | GCC Ala (A) | GAC Asp (D) | GGC Gly (G) |
|   | GTA Val (V) | GCA Ala (A) | GAA Glu (E) | GGA Gly (G) |
|   | GTG Val (V) | GCG Ala (A) | GAG Glu (E) | GGG Gly (G) |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available, for example, at the "Codon Usage Database", and these tables can be adapted in a number of ways. See Nakamura, Y., et al. *Nucl. Acids Res.* 28:292 (2000). Codon usage tables for yeast, calculated from GenBank Release 128.0 [15 Feb. 2002], are reproduced below as Table B. This table uses mRNA nomenclature, and so instead of thymine (T) which is found in DNA, the tables use uracil (U) which is found in RNA. The Table has been adapted so that frequencies are calculated for each amino acid, rather than for all 64 codons.

TABLE B

Codon Usage Table for *Saccharomyces cerevisiae* Genes

| Amino Acid | Codon | Number | Frequency per thousand |
|---|---|---|---|
| Phe | UUU | 170666 | 26.1 |
| Phe | UUC | 120510 | 18.4 |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Ile | AUU | 196893 | 30.1 |
| Ile | AUC | 112176 | 17.2 |
| Ile | AUA | 116254 | 17.8 |
| Met | AUG | 136805 | 20.9 |
| Val | GUU | 144243 | 22.1 |
| Val | GUC | 76947 | 11.8 |
| Val | GUA | 76927 | 11.8 |
| Val | GUG | 70337 | 10.8 |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Pro | CCU | 88263 | 13.5 |
| Pro | CCC | 44309 | 6.8 |
| Pro | CCA | 119641 | 18.3 |
| Pro | CCG | 34597 | 5.3 |
| Thr | ACU | 132522 | 20.3 |
| Thr | ACC | 83207 | 12.7 |
| Thr | ACA | 116084 | 17.8 |
| Thr | ACG | 52045 | 8.0 |
| Ala | GCU | 138358 | 21.2 |
| Ala | GCC | 82357 | 12.6 |
| Ala | GCA | 105910 | 16.2 |
| Ala | GCG | 40358 | 6.2 |
| Tyr | UAU | 122728 | 18.8 |
| Tyr | UAC | 96596 | 14.8 |
| His | CAU | 89007 | 13.6 |
| His | CAC | 50785 | 7.8 |
| Gln | CAA | 178251 | 27.3 |
| Gln | CAG | 79121 | 12.1 |
| Asn | AAU | 233124 | 35.7 |
| Asn | AAC | 162199 | 24.8 |
| Lys | AAA | 273618 | 41.9 |
| Lys | AAG | 201361 | 30.8 |
| Asp | GAU | 245641 | 37.6 |
| Asp | GAC | 132048 | 20.2 |
| Glu | GAA | 297944 | 45.6 |
| Glu | GAG | 125717 | 19.2 |
| Cys | UGU | 52903 | 8.1 |
| Cys | UGC | 31095 | 4.8 |
| Trp | UGG | 67789 | 10.4 |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Gly | GGU | 156109 | 23.9 |
| Gly | GGC | 63903 | 9.8 |
| Gly | GGA | 71216 | 10.9 |
| Gly | GGG | 39359 | 6.0 |
| Stop | UAA | 6913 | 1.1 |
| Stop | UAG | 3312 | 0.5 |
| Stop | UGA | 4447 | 0.7 |

By utilizing this or similar tables, one of ordinary skill in the art can apply the frequencies to any given polypeptide sequence, and produce a nucleic acid fragment of a codon-optimized coding region which encodes the polypeptide, but which uses codons optimal for a given species.

Randomly assigning codons at an optimized frequency to encode a given polypeptide sequence can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNT1 Suite, available from InforMax, Inc., Bethesda, Md., and the "backtranslate" function in the GCG—Wisconsin Package, available from Accelrys, Inc., San Diego, Calif. In addition, various resources are publicly available to codon-optimize coding region sequences. Constructing a rudimentary algorithm to assign codons based on a given frequency can also easily be accomplished with basic mathematical functions by one of ordinary skill in the art.

Codon-optimized coding regions can be designed by various methods known to those skilled in the art including software packages such as "synthetic gene designer" (Wu et al., Protein Expr. Purif. 47(2):441-5 (2006)) (University of Maryland at Baltimore County, Baltimore, Md.).

Promoter Nucleic Acid Sequences—"Genetic Switches"

In some embodiments, the promoter activity is sensitive to one or more physiochemical differences between propagation and production stages of fermentation. In embodiments, the promoter activity is sensitive to the dissolved oxygen concentration. In embodiments, the promoter activity is sensitive to the glucose concentration. In some embodiments, the promoter activity is sensitive to the source of the fermentable carbon substrate. In still a further embodiment, the promoter activity is sensitive to the concentration of butanol in fermentation medium. In still a further embodiment, the promoter activity is sensitive to the pH in the fermentation medium. In still a further embodiment, the promoter activity is sensitive to the temperature in the fermentation medium. In embodiments, the promoter activity provides for differential expression in propagation and production stages of fermentation.

Production and Propagation

Promoter nucleic acid sequences useful in the invention include those identified using "promoter prospecting" described and exemplified herein including those that comprise nucleic acid sequences which are at least about 80%, 85%, 90%, 95%, 96%, 97%, 98%, 99%, or 100% identical to the nucleotide sequences of SEQ ID NOs: 141-163, including variants, fragments or derivatives thereof that confer or increase sensitivity to fermentation conditions, such as, the concentration of oxygen, butanol, isobutyraldehyde, isobutyric acid, acetic acid, or a fermentable carbon substrate in the fermentation medium. A subset of these suitable promoter nucleic acid sequences are set forth in Tables 1 and 2 below.

TABLE 1

Promoters -Upregulated in Corn Mash Production Fermentor Compared to Propagation Tank

| Gene/ORF Associated with Promoter | Promoter Polynucleotide SEQ ID NO: | Description** |
|---|---|---|
| HXK2 | 141 | Hexokinase isoenzyme 2 that catalyzes phosphorylation of glucose in the cytosol; predominant hexokinase during growth on glucose; functions in the nucleus to repress expression of HXK1 and GLK1 and to induce expression of its own gene. |
| IMA1 | 140 | Major isomaltase (alpha-1,6-glucosidase) required for isomaltose utilization; has specificity for isomaltose, palatinose, and methyl-alpha-glucoside; member of the IMA isomaltase family |
| SLT2 | 142 | Serine/threonine MAP kinase involved in regulating the maintenance of cell wall integrity and progression through the cell cycle; regulated by the PKC1-mediated signaling pathway. |
| YHR210c | 143 | Putative protein of unknown function; non-essential gene; highly expressed under anaeorbic conditions; sequence similarity to aldose 1-epimerases such as GAL10. |
| YJL171c | 144 | GPI-anchored cell wall protein of unknown function; induced in response to cell wall damaging agents and by mutations in genes involved in cell wall biogenesis; sequence similarity to YBR162C/TOS1, a covalently bound cell wall protein. |
| PUN1 | 145 | Plasma membrane protein with a role in cell wall integrity; co-localizes with Sur7p in punctate membrane patches; null mutant displays decreased thermotolerance; transcription induced upon cell wall damage and metal ion stress |
| PRE8 | 146 | Alpha 2 subunit of the 20S proteasome |
| COS3 | 147 | Protein involved in salt resistance; interacts with sodium:hydrogen antiporter Nha1p; member of the DUP380 subfamily of conserved, often subtelomerically-encoded proteins. |
| DIA1 | 148 | Protein of unknown function, involved in invasive and pseudohyphal growth; green fluorescent protein (GFP)-fusion protein localizes to the cytoplasm in a punctate pattern. |
| YNR062C | 149 | Putative membrane protein of unknown function |
| PRE10 | 150 | Alpha 7 subunit of the 20S proteasome. |
| AIM45 | 151 | Putative ortholog of mammalian electron transfer flavoprotein complex subunit ETF-alpha; interacts with frataxin, Yfh1p; null mutant displays elevated frequency of mitochondrial genome loss; may have a role in oxidative stress response |

TABLE 2

Promoters Strongly-Downregulated in Corn Mash Production Fermentor Compared to Propagation Tank

| Gene/ORF Associated with Promoter | Promoter Polynucleotide SEQ ID NO: | Description** |
|---|---|---|
| ZRT1 | 152 | High-affinity zinc transporter of the plasma membrane, responsible for the majority of zinc uptake; transcription is induced under low-zinc conditions by the Zap1p transcription factor. |
| ZRT2 | 153 | Low-affinity zinc transporter of the plasma membrane; transcription is induced under low-zinc conditions by the Zap1p transcription factor. |
| PHO84 | 154 | High-affinity inorganic phosphate (Pi) transporter and low-affinity manganese transporter; regulated by Pho4p and Spt7p; mutation confers resistance to arsenate; exit from the ER during maturation requires Pho86p. |
| PCL1 | 155 | Cyclin, interacts with cyclin-dependent kinase Pho85p; member of the Pcl1,2-like subfamily, involved in the regulation of polarized growth and morphogenesis and progression through the cell cycle; localizes to sites of polarized cell growth. |
| ARG1 | 156 | Argininosuccinate synthetase, catalyzes the formation of L-argininosuccinate from citrulline and L-aspartate in the arginine biosynthesis pathway; potential Cdc28p substrate. |
| ZPS1 | 157 | Putative GPI-anchored protein; transcription is induced under low-zinc conditions, as mediated by the Zap1p transcription factor, and at alkaline pH. |
| FIT2 | 158 | Mannoprotein that is incorporated into the cell wall via a glycosylphosphatidylinositol (GPI) anchor, involved in the retention of siderophore-iron in the cell wall. |
| FIT3 | 159 | Mannoprotein that is incorporated into the cell wall via a glycosylphosphatidylinositol (GPI) anchor, involved in the retention of siderophore-iron in the cell wall. |
| FRE5 | 160 | Putative ferric reductase with similarity to Fre2p; expression induced by low iron levels; the authentic, non-tagged protein is detected in highly purified mitochondria in high-throughput studies. |
| CSM4 | 161 | Protein required for accurate chromosome segregation during meiosis; involved in meiotic telomere clustering (bouquet formation) and telomere-led rapid prophase movements. |
| SAM3 | 162 | High-affinity S-adenosylmethionine permease, required for utilization of S-adenosylmethionine as a sulfur source; has similarity to S-methylmethionine permease Mmp1p. |
| FDH2 | 163 | NAD(+)-dependent formate dehydrogenase, may protect cells from exogenous formate; YPL275W and YPL276W comprise a continuous open reading frame in some *S. cerevisiae* strains but not in the genomic reference strain S288C. |

**Descriptions for Tables 1 and 2 from Saccharomyces Genome Database.

In embodiments of the invention, the promoter nucleic acid sequence is sensitive to the concentration of fermentable carbon substrates in fermentation medium. In yet a further embodiment, the promoter nucleic acid sequence is sensitive to the concentration of a fermentable carbon substrate selected from the group consisting of: monosaccharides, oligosaccharides, polysaccharides, fatty acids, and mixtures thereof.

In embodiments of the invention, promoter nucleic acid sequences suitable for use in the invention comprise nucleotide sequences that are at least about 80%, 85%, 90%, 95%, 96%, 97%, 98%, 99% or 100% identical to a sequence selected from the group consisting of: SEQ ID NO: 140 [IMA1/YGR287], [HXK1], SEQ ID NO: 141 [HXK2], SEQ ID NO: 142 [SLT2], SEQ ID NO: 143 [YHR210c], SEQ ID NO: 144 [YJL171c], SEQ ID NO: 145 [PUN1], SEQ ID NO: 146 [PRE8], SEQ ID NO: 147 [COS3], SEQ ID NO: 148 [DIA1], SEQ ID NO: 149 [YNR062C], SEQ ID NO: 150 [PRE10], SEQ ID NO: 151 [AIM45], SEQ ID NO: 152 [ZRT1], SEQ ID NO: 153 [ZRT2], SEQ ID NO: 154 [PHO84], SEQ ID NO: 155 [PCL1], SEQ ID NO: 156 [ARG1], SEQ ID NO: 157 [ZPS1], SEQ ID NO: 158 [FIT2], SEQ ID NO: 159 [FIT3], SEQ ID NO: 160 [FRE5], SEQ ID NO: 161 [CSM4], SEQ ID NO: 160 [SAM3], SEQ ID NO: 163 [FDH2] or a variant, fragment or derivative thereof.

In embodiments, promoter nucleic acid sequences suitable for use in the invention are selected from the group consisting of: SEQ ID NO: 140 [IMA1/YGR287], [HXK1], SEQ ID NO: 141 [HXK2], SEQ ID NO: 142 [SLT2], SEQ ID NO: 143 [YHR210c], SEQ ID NO: 144 [YJL171c], SEQ ID NO: 145 [PUN1], SEQ ID NO: 146 [PRE8], SEQ ID NO: 147 [COS3], SEQ ID NO: 148 [DIA1], SEQ ID NO: 149 [YNR062C], SEQ ID NO: 150 [PRE10], SEQ ID NO: 151 [AIM45], SEQ ID NO: 152 [ZRT1], SEQ ID NO: 153 [ZRT2], SEQ ID NO: 154 [PHO84], SEQ ID NO: 155 [PCL1], SEQ ID NO: 156 [ARG1], SEQ ID NO: 157 [ZPS1], SEQ ID NO: 158 [FIT2], SEQ ID NO: 159 [FIT3], SEQ ID NO: 160 [FRE5], SEQ ID NO: 161 [CSM4], SEQ ID NO: 162 [SAM3], SEQ ID NO: 163 [FDH2] or a variant, fragment or derivative thereof.

Oxygen

In embodiments, the promoter nucleic acid sequence is sensitive to the concentration of oxygen in fermentation medium.

In embodiments, a distinguishing characteristic between the propagation and production stages is the presence of high (for example, greater than about 5%) dissolved oxygen concentrations during most of the propagation phase, and low (for example, less than about 5% or less than about 3%) dissolved oxygen concentrations, frequently even anaerobic conditions, in most of the production phase. Consequently, in embodiments, "high" vs. "low" dissolved oxygen concentrations results in the increase or decrease of expression of biocatalyst polypeptides of interest in the propagation vs. the production stage of the process. Examples of such biocatalyst polypeptides include, but are not limited to, acetohydroxyacid synthase (AHAS), glucose-6-phosphate dehydrogenase (ZWF1), phosphoketolase (XPK), and glycerol-3-phosphate dehydrogenase (GPD), described elsewhere herein.

In embodiments, promoters of the indicated genes allow for a lower expression of desired biocatalyst polypeptides and consequently the gene products (biocatalyst polypeptides) under aerobic than under anaerobic conditions. Such biocatalyst polypeptides comprise, but are not limited to the acetohydroxyacid synthase (AHAS) of the butanol biosynthesis pathway. Saccharomyces cerevisiae promoter nucleic acid sequences affected by aerobic or anaerobic conditions are shown in Table 3. In embodiments, the promoter is a HEM13 (SEQ ID NO: 176) promoter or active fragment thereof. In embodiments, the promoter is a HES1 (SEQ ID NO: 177) promoter or active fragment thereof. In embodiments, the promoter nucleic acid sequences provide lower expression of polynucleotides encoding biosynthetic pathway polypeptides during the propagation phase and increased expression during production phase, for example acetohydroxyacid synthase. Suitable promoter nucleic acid sequences are provided herein and/or are available in the art (Boles, E., W. Lehnert, et al. (1993) "The role of the NAD-dependent glutamate dehydrogenase in restoring growth on glucose of a *Saccharomyces cerevisiae* phosphoglucose isomerase mutant." *Eur. J. Biochem.* 217(1): 469-77. Heux, S., A. Cadiere, et al. (2008) "Glucose utilization of strains lacking PGI1 and expressing a transhydrogenase suggests differences in the pentose phosphate capacity among *Saccharomyces cerevisiae* strains." *FEMS Yeast Res.* 8(2): 217-24. Kresnowati, M. T., W. A. van Winden, et al. (2006) "When transcriptome meets metabolome: fast cellular responses of yeast to sudden relief of glucose limitation." *Mol Syst Biol* 2: 49. Kundaje, A., X. Xin, et al. (2008) "A predictive model of the oxygen and heme regulatory network in yeast." *PLoS Comput. Biol.* 4(11): e1000224. Lai, L. C., A. L. Kosorukoff, et al. (2005) "Dynamical remodeling of the transcriptome during short-term anaerobiosis in *Saccharomyces cerevisiae*: differential response and role of Msn2 and/or Msn4 and other factors in galactose and glucose media." *Mol. Cell Biol.* 25(10): 4075-91. ter Linde, J. J., H. Liang, et al. (1999) "Genome-wide transcriptional analysis of aerobic and anaerobic chemostat cultures of *Saccharomyces cerevisiae*." *J. Bacteriol.* 181(24): 7409-13. van den Brink, J., P. Daran-Lapujade, et al. (2008) "New insights into the *Saccharomyces cerevisiae* fermentation switch: dynamic transcriptional response to anaerobicity and glucose-excess." *BMC Genomics* 9: 100. Wang, Y., M. Pierce, et al. (2004) "Ras and Gpa2 mediate one branch of a redundant glucose signaling pathway in yeast." *PLoS Biol* 2(5): E128). Promoter nucleic acid sequences useful in the invention include those comprising sequences provided herein and those that comprise sequences which are at least about 80%, 85%, 90%, 95%, 96%, 97%, 98%, 99%, or 100% identical to the nucleotide sequences given in Table 3, including variants, fragments or derivatives thereof that confer or increase sensitivity to the concentration of oxygen. In embodiments, the promoter nucleic acid sequence comprises at least about 80%, 85%, 90%, 95%, 96%, 97%, 98%, 99%, or 100% identity to SEQ ID NO: 775 [ANB1], 776 [TIR1], 777 [HEM13], or 778 [HES1] or a variant, fragment, or derivative thereof. In embodiments, the biocatalyst polypeptide comprises at least about 90%, at least about 95%, at least about 99% or at 100% identity to *B. subtilis* AlsS (SEQ ID NO: 1) or an active fragment thereof.

TABLE 3

Example Candidate Promoter Sequences for Higher Expression in Low Oxygen

| Gene ID | Other name | SEQ ID NO: | Gene ID | Other name | SEQ ID NO: |
|---|---|---|---|---|---|
| YJR150C | DAN1 | 186 | YMR119W | ASI1 | 231 |
| YOR237W | HES1 | 177 | YKL079W | SMY1 | 232 |
| YJR047C | ANB1 | 188 | YLR413W | YLR413W | 233 |
| YAL068C | YAL068C | 189 | ARE1 | YCR048W | 234 |
| YLR461W | PAU4 | 190 | AUS1 | YOR011W | 235 |
| YML058W-A | HUG1 | 191 | DAN1 | YJR150C | 171 |
| YLL064C | YLL064C | 192 | DAN4 | YJR151C | 236 |
| YGR131W | YGR131W | 193 | EUG1 | YDR518W | 237 |
| YOR010C | TIR2|SRP2 | 194 | FET4 | YMR319C | 238 |
| YER011W | TIR1|SRP1 | 195 | PAU6 | YNR076W | 239 |
| YIL176C | YIL176C | 196 | PMT5 | YDL093W | 240 |
| YOR009W | TIR4 | 197 | TIR2 | YOR010C | 172 |
| YOL101C | IZH4 | 198 | TIR4 | YOR009W | 241 |
| YDR213W | UPC2 | 199 | YSR3 | YKR053C | 242 |
| YNR075W | COS10 | 200 | YMR319C | FET4 | 243 |
| YGL039W | YGL039W | 201 | YPR194C | OPT2 | 244 |
| YHR048W | YHR048W | 202 | YIR019C | STA1/FLO11 | 245 |
| YOR277W | ATF1 | 203 | YHL042W | YHL042W | 246 |
| YGR286C | BIO2 | 204 | YHR210C | YHR210C | 247 |
| YDR044W | HEM13 | 176 | YGL162W | SUT1/STO1 | 248 |
| YKR003W | OSH6 | 206 | YHL044W | YHL044W | 249 |
| YLR194C | YLR194C | 207 | YOL015W | IRC10 | 250 |
| YIR0033W | MGA2 | 208 | YJR047C | ANB1/TIF51B | 170 |
| YOR175C | YOR175C | 209 | YJR150C | DAN1 | 186 |
| YOL002C | IZH2 | 210 | YML083C | YML083C | 251 |
| YBL106C | SNI2 | 211 | YBR085W | AAC3 | 252 |
| YHR004C | NEM1 | 212 | YOR010C | TIR2 | 194 |
| YMR006C | PLB2 | 213 | YER011W | TIR1 | 175 |
| YJR116W | YJR116W | 214 | YKR053C | YSR3/LBP2 | 253 |
| YGR0044C | CSP1 | 215 | YER188W | YER188W | 254 |
| YGR032W | FKS2 | 216 | YCL025C | AGP1 | 255 |
| YPL170W | DAP1 | 217 | YPL265W | DIP5 | 256 |

TABLE 3-continued

Example Candidate Promoter Sequences for Higher Expression in Low Oxygen

| Gene ID | Other name | SEQ ID NO: | Gene ID | Other name | SEQ ID NO: |
|---|---|---|---|---|---|
| YNR065C | YSN1 | 218 | YDL241W | YDL241W | 257 |
| YDR275W | BSC2 | 219 | YBL029W | YBL029W | 258 |
| YBR066C | NRG2 | 220 | YER014W | HEM14 | 226 |
| YBL005W-A | YBL005W-A | 221 | YLR099C | ICT1 | 227 |
| YAL005C | SSA1 | 222 | YDR085C | AFR1 | 228 |
| YLR256W | HAP1 | 223 | YGR177C | ATF2 | 229 |
| YDR186C | YDR186C | 224 | YMR038C | CCS1 | 230 |
| YMR087W | YMR087W | 225 | | | |

In other embodiments, promoter nucleic acid sequences allow for a lower expression of desired polynucleotides and consequently the encoded products under anaerobic than under aerobic conditions. Such polynucleotides comprise, but are not limited to polypeptides which may produce by-products of the butanol biosynthesis pathway such as isobutyric acid or DHMB. *Saccharomyces cerevisiae* promoter nucleic acid sequences affected by such conditions are shown in Table 4. In embodiments, the promoter nucleic acid sequences provide lower expression of genes encoding by-product producing polypeptides during the propagation phase and lower expression during production phase, for example YMR226c or aldehyde dehydrogenases, including, but not limited to, ALD6. Promoter nucleic acid sequences useful in the invention comprise those provided herein and those which comprise sequences that are at least about 80%, 85%, 90%, 95%, 96%, 97%, 98%, 99%, or 100% identical to the nucleotide sequences of Table 4, including variants, fragments or derivatives thereof that confer or increase sensitivity to the concentration of oxygen.

TABLE 4

Example Candidate Promoter Sequences for Lower Expression in Low Oxygen

| Gene ID | Other name | SEQ ID NO: |
|---|---|---|
| YMR058W | FET3 | 268 |
| YLR205C | HMX1 | 269 |
| YNL173C | MDG1 | 270 |
| YOR348C | PUT4 | 271 |
| YOR065W | CYT1 | 272 |
| YGR035C | | 273 |
| YKR046C | PET10 | 274 |
| YGL191W | COX13 | 275 |
| YHR001W-A | QCR10 | 276 |
| YLJ113C-A | | 277 |
| YBR177C | EHT1 | 278 |
| YMR145C | NDE1 | 279 |
| YLR038C | COX12 | 280 |
| YPR061C | JID1 | 281 |
| YJL048C | UBX6 | 282 |
| YLR042C | | 283 |
| YNL052W | COX5A | 284 |
| YLR395C | COX8 | 285 |
| YKL068W-A | | 286 |
| YGL032C | AGA2 | 287 |
| YDR384C | ATO3 | 288 |
| YDR185C | UPS3 | 289 |
| YHR051W | COX6 | 290 |
| YBR047W | FMP23 | 291 |
| YPR191W | QCR2 | 292 |
| YPR149W | NCE102 | 293 |
| YJL116W | QCR8 | 294 |
| YOL126C | MDH2 | 295 |
| YGR243W | FMP43 | 296 |
| YGR183C | QCR9 | 297 |
| YOR273C | TPO4 | 298 |
| YPR1458W | CUR1 | 299 |
| YIL015W | BAR1 | 300 |
| YIL155C | GUT2 | 301 |
| YMR286W | MRPL33 | 302 |
| YDR529C | QCR7 | 303 |
| YGR055W | MUP1 | 304 |
| YPL004C | LSP1 | 305 |
| YOR072W-B | | 306 |
| YLR411W | CTR3 | 307 |
| YOR100C | CRC1 | 308 |
| YDR078C | SHU2 | 309 |
| YGR053C | | 310 |
| YCR061W | | 311 |
| YOR084W | LPX1 | 312 |
| YDR313C | PIB1 | 313 |
| YBR039W | ATP3 | 314 |
| YPR002W | PDH1 | 315 |
| YJL173C | RFA3 | 316 |
| YDR173C | ARG82 | 317 |
| YPR159C-A | | 318 |
| YJL131C | AIM23 | 319 |
| YJL180C | ATP12 | 320 |
| YPR036W-A | | 321 |
| YHR090C | YNG2 | 322 |
| YPR161C | PNS1 | 323 |
| YOR390W | | 324 |
| YBL030C | PET9 | 325 |
| YPR124W | CTR1 | 326 |
| YJR077C | MIR1 | 327 |
| YJR122W | IBA57 | 328 |
| YLL028W | TPO1 | 329 |
| YDL004W | ATP16 | 330 |
| YDR342C | HXT7 | 331 |
| YDR461W | MFA1 | 332 |
| YDR298C | ATP5 | 333 |
| YMR215W | GAS3 | 334 |
| YPL271W | ATP15 | 335 |
| YMR251W-A | HOR7 | 336 |
| YDL067C | COX9 | 337 |
| YLJ103C | GSM1 | 338 |
| YIR038C | GTT1 | 339 |
| YPR028W | YOP1 | 340 |
| YDR253C | MET32 | 341 |
| YBL099W | ATP1 | 342 |
| YPL002C | SNF8 | 343 |
| YNL307C | MCK1 | 344 |
| YPR165W | RHO1 | 345 |
| YGR063C | SPT4 | 346 |
| YMR009W | ADI1 | 347 |
| YMR256C | COX7 | 348 |
| YBR185C | MBA1 | 349 |
| YPR047W | MSF1 | 350 |
| YMR302C | YME2 | 351 |
| YDL086W | | 352 |
| YGL101W | | 353 |

TABLE 4-continued

Example Candidate Promoter Sequences for Lower Expression in Low Oxygen

| Gene ID | Other name | SEQ ID NO: |
|---|---|---|
| YIR035C |  | 354 |
| YLR108C |  | 355 |
| YOR388C | FDH1 | 356 |
| YPL275W | FDH2 | 357 |
| YPL276W | FDH2 | 358 |
| YDR256C | CTA1 | 359 |
| YHR096C | HXT5 | 360 |
| YNL195C |  | 361 |
| YGR110W | CLD1 | 362 |
| YCR010C | ADY2 | 363 |
| YDL218W |  | 364 |
| YPL223C | GRE1 | 365 |
| YJR095W | SFC1 | 366 |
| YMR303C | ADH2 | 367 |
| YGR236C | SPG1 | 368 |
| YHR139C | SPS100 | 369 |
| YRP151C | SUE1 | 370 |
| YMR107W | SPG4 | 371 |
| YMR118C | SHH3 | 372 |
| YLR174W | IDP2 | 373 |
| YPL201C | YIG1 | 374 |
| YDR380W | ARO10 | 375 |
| YML054C | CYB2 | 376 |
| YPL147W | PXA1 | 377 |
| YDR070C | FMP16 | 378 |
| YPR001W | CIT3 | 379 |
| YER065C | ICL1 | 380 |
| YKR009C | FOX2 | 381 |
| YLL053C |  | 382 |
| YGR256W | GND2 | 383 |

Glucose

In embodiments, a distinguishing condition between the propagation and production phases is the presence of low glucose concentrations during the propagation phase and the presence of excess glucose during the production phase. Consequently "high" vs. "low" glucose concentrations could be used to express/repress biocatalyst polypeptide expression in the propagation vs. production phase. Examples of such biocatalyst polypeptides of interest to differentially control their expression include, but are not limited to, acetohydroxyacid synthase (AHAS), glucose-6-phosphate dehydrogenase (ZWF1), phosphoketolase (XPK), glycerol-3-phosphate dehydrogenase (GPD).

The hexose transporter gene family in S. cerevisiae contains the sugar transporter genes HXT1 to HXT17, GAL2 and the glucose sensor genes SNF3 and RGT2. The proteins encoded by HXT1 to HXT4 and HXT6 to HXT7 are considered to be the major hexose transporters in S. cerevisiae. The expression of most of the HXT glucose transporter genes is known to depend on the glucose concentration (Ozcan, S, and M. Johnston (1999). "Function and regulation of yeast hexose transporters." Microbiol. Mol. Biol. Rev. 63(3): 554-69). Consequently their promoters are provided herein for differential expression of genes under "high" or "low" glucose concentrations.

In embodiments, promoter nucleic acid sequences comprising sequences from the promoter region of HXT2 (SEQ ID NO: 384), HXT5 (SEQ ID NO: 360), HXT6 (SEQ ID NO: 386), or HXT7 (SEQ ID NO: 331) are employed for higher expression under glucose-limiting conditions, and lower expression under glucose-excess conditions. HXT5, HXT6 and HXT7 show also strong expression with growth on ethanol, in contrast to HXT2 (Diderich, J. A., Schepper, M., et al. (1999). "Glucose uptake kinetics and transcription of HXT genes in chemostat cultures of Saccharomyces cerevisiae." J. Biol. Chem. 274(22): 15350-9. It has been reported that under different oxygen conditions, HXT5 and HXT6 expression showed variability (Rintala, E., M. G. Wiebe, et al. (2008). "Transcription of hexose transporters of Saccharomyces cerevisiae is affected by change in oxygen provision." BMC Microbiol. 8: 53.), however, equipped with this disclosure, one of skill in the art is readily able to make and test such promoter constructs under conditions relevant for a desired production process. Promoter nucleic acid sequences useful in the invention comprise those provided herein and those that comprise nucleic acid sequences which are at least about 80%, 85%, 90%, 95%, 96%, 97%, 98%, 99%, or 100% identical to the nucleotide sequences of HXT2 (SEQ ID NO: 384), HXT5 (SEQ ID NO: 360), HXT6 (SEQ ID NO: 386), or HXT7 (SEQ ID NO: 331), including variants, fragments or derivatives thereof that confer or increase sensitivity to the concentration of oxygen. In embodiments, the promoter nucleic acid sequence comprises at least about 80%, 85%, 90%, 95%, 96%, 97%, 98%, 99%, or 100% identity to SEQ ID NO: 772 [HXT5] or 773 [HXT7] or a fragment or derivative thereof. In embodiments, the biocatalyst polypeptide comprises at least about 90%, at least about 95%, at least about 99% or at 100% identity to B. subtilis AlsS (SEQ ID NO: 1) or an active fragment thereof.

In embodiments, HXT1 is the promoter for glucose-based control of gene expression, providing high expression under conditions of high glucose. HXT3 may have promise in promoter strength, but may also show some low expression under very low glucose concentrations (Brauer, M. J., C. Huttenhower, et al. (2008). "Coordination of growth rate, cell cycle, stress response, and metabolic activity in yeast." Mol Biol Cell 19(1): 352-67). Equipped with this disclosure, one of skill in the art will be able to make and test the suitability of promoter constructs under the conditions relevant for a desired process. Accordingly, promoter nucleic acid sequences useful in the invention comprise those provided herein and those that comprise nucleic acid sequences which are at least about 80%, 85%, 90%, 95%, 96%, 97%, 98%, 99%, or 100% identical to the nucleotide sequences of HXT1 (SEQ ID NO: 168), HXT3 (SEQ ID NO: 169), HXT4 (SEQ ID NO: 388), or ENO2 (SEQ ID NO: 173), including variants, fragments or derivatives thereof that confer or increase sensitivity to the concentration of oxygen. In embodiments, the promoter nucleic acid sequence comprises at least about 80%, 85%, 90%, 95%, 96%, 97%, 98%, 99%, or 100% identity to SEQ ID NO: 768 [HXT3], 769 [HXT1], or 711 [hybrid promoter comprising HXT1 promoter nucleic acid sequence] or a fragment or derivative thereof. In embodiments, the biocatalyst polypeptide comprises at least about 90%, at least about 95%, at least about 99% or at 100% identity to B. subtilis AlsS (SEQ ID NO: 1) or an active fragment thereof.

pH

As disclosed herein, in some embodiments, a distinguishing condition between the propagation and production phases is the pH. In embodiments, promoter nucleic acid sequences from the Saccharomyces cerevisiae YKL096W-A (CWP2) promoter (SEQ ID NO: 389) or YER150W (SPI1) promoter (SEQ ID NO: 190) are employed to govern differential expression in processes where the pH is different in different phases. Equipped with this disclosure, one of skill in the art will be able to make and test the suitability of promoter constructs under the conditions relevant for a desired process. Accordingly, promoter nucleic acid sequences useful in the invention include those provided herein and those that are at least about 80%, 85%, 90%, 95%, 96%, 97%, 98%, 99%, or 100% identical to the nucleotide sequences of SEQ ID NO:

389 or SEQ ID NO: 190), including variants, fragments or derivatives thereof that confer or increase sensitivity to pH.

Temperature

As disclosed herein, in some embodiments, a distinguishing condition between the propagation and production phases is the temperature. In embodiments, promoter nucleic acid sequences from the *Saccharomyces cerevisiae* YBR027W promoter (HSP26) (SEQ ID NO: 391) or from the YLL026W (HSP104) promoter (SEQ ID NO: 392) are employed to govern differential expression in processes where the temperature is different in different phases. Temperature sensitive promoters and candidate temperature sensitive promoters are also available in the art (Becerra, M., et al. Comp Func Genomics (2003) 4(4): 366-75 and Al-Fageeh, M B, et al. Biochem J (2006) 397(2):247-59, both incorporated by reference). Equipped with this disclosure, one of skill in the art will be able to make and test the suitability of promoter constructs under the conditions relevant for a desired process. Accordingly, promoter nucleic acid sequences useful in the invention include those provided herein and those that are at least about 80%, 85%, 90%, 95%, 96%, 97%, 98%, 99%, or 100% identical to the nucleotide sequences of SEQ ID NO: 391 or SEQ ID NO: 392, including variants, fragments or derivatives thereof that confer or increase sensitivity to temperature.

Butanol

As disclosed herein, in some embodiments, a distinguishing condition between the propagation and production phases is the concentration of fermentation product such as butanol or 2-butanone. In embodiments, promoter nucleic acid sequences from the *Saccharomyces cerevisiae* YOL151W (GRE2) promoter (SEQ ID NO: 393) or from the YOR153W (PDR5) promoter (SEQ ID NO: 394) are employed to govern differential expression in processes where the butanol level is different in different phases. Equipped with this disclosure, one of skill in the art will be able to make and test the suitability of promoter constructs under the conditions relevant for a desired process. Accordingly, promoter nucleic acid sequences useful in the invention include those provided herein and those that are at least about 80%, 85%, 90%, 95%, 96%, 97%, 98%, 99%, or 100% identical to the nucleotide sequences of SEQ ID NO: 393 or SEQ ID NO: 394, including variants, fragments or derivatives thereof that confer or increase sensitivity to the concentration of butanol.

Hybrid Promoters

It will be appreciated that "hybrid promoters" which comprise nucleic acid sequences from more than one promoter region can be constructed and employed in embodiments herein.

For example, in order to add an additional negative control trigger through the level of dissolved oxygen in the culture medium, a Rox1 binding site (eg. "ATTGT") or a sequence comprising a Rox 1 binding site (eg. SEQ ID NO: 395) (Badis, G. Mol Cell (2008) 32(6):878-87; Balasubramanian, B. et al. Mol Cell Biol (1993) 13910) 6071-8.) could be added to either the regulatory (e.g. promoter) or to the coding sequence of the gene of interest. A Rox1 binding site may already be present for the HXT1 promoter based on bioinformatic analysis (MacIsaac, K. D., T. Wang, et al. (2006). "An improved map of conserved regulatory sites for *Saccharomyces cerevisiae*." BMC Bioinformatics 7: 113.) Rox1 and other transcription motifs are described, for example, in Badis, et al. Mol Cell (2008) 32(6): 878-87. Transcription factor motifs can also be found in the TRANSFAC database (Matys V, et al. Nucleic Acids Res. (2003) 31(1):374-8).

Hybrid promoter nucleic acid sequences may comprise FBA1 promoter sequences (SEQ ID NO: 779) or a variant, fragment or derivative thereof. In one embodiment, a hybrid promoter nucleic acid sequence comprises nucleic acid sequences that are at least about 80%, 85%, 90%, 95%, 96%, 97%, 98%, 99% or 100% identical to FBA1 (SEQ ID NO: 779 or SEQ ID NO: 770) or a variant, fragment or derivative thereof. In one embodiment, a hybrid promoter nucleic acid sequence comprises nucleic acid sequences that are at least about 80%, 85%, 90%, 95%, 96%, 97%, 98%, 99% or 100% identical to HXT1 (SEQ ID NO: 168) or DAN1 (SEQ ID NO: 186) promoters or a variant, fragment or derivative thereof. In embodiments, the promoter nucleic acid sequence comprises at least about 80%, 85%, 90%, 95%, 96%, 97%, 98%, 99% or 100% identity to P[FBA1::DAN1_AR314) (SEQ ID NO: 686) or a variant, fragment or derivative thereof. In embodiments, the promoter nucleic acid sequence comprises at least about 80%, 85%, 90%, 95%, 96%, 97%, 98%, 99% or 100% identity to P[FBA1::HXT1_331] (SEQ ID NO: 711) or a variant, fragment or derivative thereof.

In embodiments, the biocatalyst polypeptide comprises at least about 90%, at least about 95%, at least about 99% or at 100% identity to *B. subtilis* AlsS (SEQ ID NO: 1) or an active fragment thereof.

In embodiments, an expression construct comprises SEQ ID NO: 711 or a polynucleotide encoding a polypeptide having at least about 90%, at least about 95%, at least about 99% or at 100% identity to SEQ ID NO: 1 or both. In embodiments, an expression construct comprises at least about 90%, at least about 95%, at least about 99% or at 100% identity to SEQ ID NO: 790. In embodiments, a recombinant host cell comprises such an expression construct, and may further comprise an isobutanol biosynthetic pathway. In embodiments, such a recombinant host cell may be employed in methods wherein it is contacted with a carbon substrate under conditions whereby isobutanol is produced and optionally recovered.

Identification and Isolation of Additional Suitable Genetic Switches: "Promoter Prospecting"

Provided herein are methods for identifying promoter nucleic acid sequences that are sensitive to changes in cellular environment, i.e., they preferentially increase or decrease gene expression under certain conditions. For some embodiments disclosed herein, the process for promoter selection involves RNA transcript comparison between microbial cells grown under selected propagation conditions and cells grown under selected production conditions. Promoters associated with RNA transcripts that are upregulated or downregulated during the propagation phase as compared to during the production phase are suitable for use in the invention. Promoters associated with RNA transcripts that are upregulated or downregulated during the production phase as compared to the propagation phase are also suitable for use in the invention.

Another embodiment of the invention is directed to a method for screening candidate promoter sequences that are preferentially expressed during the production phase of fermentation, comprising:

(a) incubating a microorganism under propagation conditions;

(b) isolating ribonucleic acid molecules from the microorganism incubated in (a);

(c) incubating a microorganism under production conditions;

(d) isolating ribonucleic acid molecules from the microorganism incubated in (c);

(e) selecting only those isolated ribonucleic acid molecules in (d) that are expressed at a higher level than the corresponding isolated ribonucleic acid molecules in (b); and (f) determining the polynucleotide sequences of the promoters associated with the expression of the ribonucleic acid molecules selected in (e).

Another embodiment of the invention is directed to a method for screening candidate promoter sequences that are preferentially transcribed less during the production phase of fermentation, comprising:
(a) incubating a microorganism under propagation conditions;
(b) isolating ribonucleic acid molecules from the microorganism incubated in (a);
(c) incubating a microorganism under production conditions;
(d) isolating ribonucleic acid molecules from the microorganism incubated in (c);
(e) selecting only those isolated ribonucleic acid molecules in (d) that are expressed at a lower level than the corresponding isolated ribonucleic acid molecules in (b); and
(f) determining the polynucleotide sequences of the promoters associated with the expression of the ribonucleic acid molecules selected in (e).

Another embodiment of the invention is directed to a method for screening candidate promoter sequences that are preferentially inhibited during the biomass propagation phase, comprising:
(a) incubating a microorganism under propagation conditions;
(b) isolating ribonucleic acid molecules from the microorganism incubated in (a);
(c) incubating a microorganism under production conditions;
(d) isolating ribonucleic acid molecules from the microorganism incubated in (c);
(e) selecting only those isolated ribonucleic acid molecules in (d) that are expressed at a higher level than the corresponding isolated ribonucleic acid molecules in (b); and
(f) determining the polynucleotide sequences of the promoters associated with the expression of the ribonucleic acid molecules selected in (e).

In one embodiment, the ribonucleic acid molecules isolated in (b) and (d) are introduced into a reporter construct. In a specific embodiment, the ribonucleic acid molecules isolated in (b) and (d) are introduced into a fluorescence reporter construct. In one embodiment, the fluorescence reporter construct expresses green fluorescent protein (GFP). In another embodiment, the propagation conditions comprise growing the microorganism in fermentation medium comprising low concentrations of a fermentable carbon substrate and the production conditions comprise growing the microorganism in fermentation medium comprising high concentrations of the same fermentable carbon substrate. In a specific embodiment, the fermentable carbon substrate is selected from the group consisting of: monosaccharides, oligosaccharides, polysaccharides, fatty acids, and mixtures thereof. In another embodiment, the propagation conditions comprise growing the microorganism in fermentation medium comprising a high concentration of dissolved oxygen and the production conditions comprise growing the microorganism in fermentation medium comprising a low concentration of dissolved oxygen.

In another embodiment, the methods for identifying promoter nucleic acid sequences for use in the invention further comprise performing a literature search for candidate nucleic acid sequences. For example, literature references such as Li B.-Z., et al., J. Ind. Microbiol. Biotechnol. 37:43-55 (2010), provide information as to which genes are expressed during fed-batch fermentation. Li et al. examined the transcriptional profile of yeast taken from industrial ethanol fermentations (both continuous and fed-batch using 80% corn mash and 20% grain mash as feedstocks). They sampled in the seed stage, during early "main" fermentation, and late main fermentation. They found strong up-regulation of genes involved in reserve carbohydrate metabolism and protein folding (the unfolded protein response). They detected derepression of glucose-repressed genes (e.g., HXK1 and GLK1, encoding the other hexokinase isozymes; gluconeogenic genes; high-affinity glucose transporters) and down-regulation of HXK2, even at high residual glucose (15 and 23 g/L, respectively, in the continuous and batch processes). The HXK2 response observed by Li et al. differs than what was observed in the promoter prospecting experiments in the Examples discussed below.

Understanding the genetic aspects of how yeast respond rapidly to shifts from aerobic to anaerobic conditions may offer some guidance as to which oxygen-sensitive promoter nucleic acid sequences could potentially be suitable in the invention. At the whole-genome level, fermentative functions are induced, and activities in respirofermentative metabolism, the cell cycle, and translation are down-regulated. The five major transcriptional regulatory networks involved include the Msn2/4, Hap1, Rox1, Hap2/3/4/5, and Upc2 networks. In one study, the genome-wide response to anaerobiosis and subsequent reoxygenation involved 1,603 genes in glucose-grown cells. See Kwast K. E., et al., J. Exp. Biol. 201:1177-1195 (1998); Kwast K. E., et al., J. Bacteriol. 184:250-256 (2002); and Lai L. C., et al., Mol. Cell. Biol. 25:4075-4091 (2005).

In some biomass production processes at scale may be described as microaerobic rather than aerobic, which may narrow the band of transcriptional response to fully anaerobic conditions. However, a few studies have been done in this range. In one study, transcript levels of a panel of 60 genes (mostly involved in carbon metabolism) were monitored in chemostats at sufficient and limiting levels of O2 provision; it was found that the overall transcript abundances decreased with decreasing oxygen availability. Only PYC1 (encoding pyruvate carboxylase) and GPP1 (encoding glycerol phosphate phosphatase) transcripts increased in the anaerobic culture compared to the micro-aerobic conditions. When (micro)-aerobic conditions were switched to anaerobic conditions, the expression of a few genes increased significantly, including 3 genes from the pentose phosphate pathway (TKL1, TAL1, and YGR032C), the respiratory gene COX5b, and the gluconeogenic genes MDH2 and PCK1. See Wiebe M. G., et al., FEMS Yeast Res. 8:140-154 (2008). No whole-genome microarray studies have been done on comparable cultures.

Other network responses to anaerobic to aerobic conditions have been described and include activiation of Yap1 networks and activation of heme-regulated networks. (Lai L C, et al., Eukaryot Cell. 2006 September; 5(9):1468-89.)

In embodiments, promoter nucleic acid sequences suitable for use in the invention comprise nucleotide sequences that are at least about 80%, 85%, 90%, 95%, 96%, 97%, 98%, 99% or 100% identical to a sequence selected from the group consisting of: [MSN2], [MSN4], [HAP1], [ROX1], [HAP2], [HAP3], [HAP4], [HAP5], [UPC2], [PYC1], [GPP1], [TKL1], [TAL1], [YGR032C], [COX5b], [MDH2], [YHR210], and [PCK1]. In embodiments, promoter nucleic acid sequences suitable for use in the invention can be selected from the group consisting of: [MSN2], [MSN4], [HAP1], [ROX1], [HAP2], [HAP3], [HAP4], [HAP5], [UPC2], [PYC1], [GPP1], [TKL1], [TAL1], [YGR032C], [COX5b], [MDH2], [YHR210], and [PCK1] or a variant, fragment or derivative thereof.

One of skill in the art, equipped with this disclosure, will be able to carry out the screening methods described herein for any microorganism, such as the recombinant host cells disclosed elsewhere herein, using conditions relevant for propagation and production of such microorganism. In embodiments, the microorganism is a yeast microorganism.

For example, an isobutanologen yeast strain known in the art or disclosed herein may be used for an isobutanol production run using the fermentation process developed for that strain and for the scale of fermentors used. The process may include (i) a biomass production phase, during which biomass is formed with a high yield on a carbon source feedstock (eg. beet molasses), and (ii) a fermentation phase, in which a carbon source feedstock (eg. corn mash) is fermented to isobutanol. Culture broth harvested from the fermentors at intervals throughout the process would provide samples including early, middle, and late timepoints of both phases. Harvested cells could be rapidly chilled, and recovered from the broth by centrifugation. RNA can then be extracted from the cell pellet by methods known in the art (eg. using Trizol reagent, Life Technologies, Grand Island N.Y.), followed by RNA analysis using standard methods (for example with a BioAnalyzer 2100; Agilent Technologies, Inc., Santa Clara Calif.) to determine a rRNA peak ratio of 1.8 or higher.

Whole-transcriptome analysis could then be performed using methods known to one skilled in the art, e.g. RNA-Seq (also known as Whole Transcriptome Shotgun Sequencing). The RNA from each timepoint could be enriched for mRNA using an oligo(dT) technology. The enriched pool would then be reverse-transcribed to cDNA, which is then fragmented to the appropriate length for the sequence method to be used. The fragmented cDNA is then prepared for sequencing (e.g. amplified to create a library) and then the DNA sequences of the fragments would be determined. The resulting raw dataset may be composed of many (typically in the millions) short sequence reads for each timepoint. Bio-informatic analysis would then be reformed to align these sequences, for example by use of a reference genome sequence available in the art. With adequate sequence coverage, then, the read depth for all genes in the genome would determined for each sample point across the fermentation process. Using bio-informatic methods known in the art, these are converted into numerical descriptions of gene expression levels. Genes with particular expression patterns are identified by methods such as cluster analysis, which reports the fold change in abundance of groups of transcripts at the various timepoints, relative to a reference point (for example, the reference could be the last timepoint in the production phase). Genes with properties of potential utility are identified, for example those with low abundance throughout the biomass production phase and high abundance during the fermentation phase (or at least during certain periods within the fermentation phase). Nucleic acid sequences corresponding to the promoters of those genes could then be tested as candidates for regulated and predictable expression of heterologous genes during the fermentation process. They could also be engineered further; for example, regulatory elements within them could be transferred to other promoters (eg. strong glycolytic promoters) to confer on them the regulatory properties of the identified genes.

Biocatalyst Polypeptides

One desirable feature of the polynucleotides, recombinant host cells, and methods disclosed herein is that accumulation of inhibitory by-products due to flux via enzymes of the butanol production pathway can be avoided during the growth phase. A non-limiting example with regard to an inhibitory by-product produced via enzymes of the isobutanol biosynthetic pathway is isobutyric acid. Another non-limiting example with regard to an inhibitory by-product produced via enzymes of the isobutanol biosynthetic pathway is isobutyraldehyde. Yet another non-limiting example with regard to an inhibitory by-product produced via enzymes of the isobutanol biosynthetic pathway is acetic acid. Some acetolactate synthase enzymes demonstrate a significant oxygenase side reaction in which molecular oxygen electrophilically attacks a highly reactive carbanion/enamine to form a peroxy-adduct that decomposes to ThDP and peracetic acid. See Tse, M. T. and Schloss, J. V., Biochemistry 32:10398-10403 (1993). The peracetic acid can further react with pyruvate to form two moles of acetate. In addition to the growth inhibitory effects and the loss of metabolic energy for fighting off the stress generated by the presence of by-products, carbon lost to the by-products adds to a lower yield of biocatalyst on the employed carbon substrate.

Another desirable feature of some embodiments is that with oxygen supply reduction equivalents produced in metabolic pathways leading to pyruvate can be oxidized to a higher fraction by the respiratory chain rather than by a biosynthetic pathway such as a butanol biosynthetic pathway. A higher fraction of pyruvate can transition the mitochondrial membrane and be further metabolized by pyruvate dehydrogenase and the tricarboxylic acid cycle. Another desirable feature of some embodiments is that without oxygen supply reduction equivalents produced in metabolic pathways leading to pyruvate may be oxidized by the butanol production pathway and a lower fraction by the glycerol production pathway. This way a lower yield of glycerol and a higher yield of butanol may be achieved.

Yet another desirable feature of some embodiments is that in case of excess pyruvic acid production, pyruvic acid can be excreted into the medium. See van Maris, A. J., et al., Appl. Environ. Micriobiol. 70:159-166 (2004). However, pyruvic acid even at very high concentrations is not growth inhibiting.

Such desirable features can be achieved using compositions and methods provided herein. For example, as shown in the Examples, compositions and methods herein provide preferential expression of the acetolactate synthase of an isobutanol production pathway during the production phase.

In one embodiment, the biocatalyst polypeptide encoded by the isolated polynucleotide of the invention confers host cell tolerance to the fermentation product. In another embodiment, the biocatalyst polypeptide encoded by the isolated polynucleotide of the invention confers host cell tolerance to fermentation by-products. In one embodiment, the biocatalyst polypeptide encoded by the isolated polynucleotide confers host cell tolerance to butanol. In another embodiment, the biocatalyst polypeptide encoded by the isolated polynucleotide confers host cell tolerance to isobutyraldehyde. In another embodiment, the biocatalyst polypeptide encoded by the isolated polynucleotide confers host cell tolerance to isobutyric acid. In another embodiment, the biocatalyst polypeptide encoded by the isolated polynucleotide confers host cell tolerance to acetic acid.

Biosynthetic Pathways

Biosynthetic pathways for the production of isobutanol that may be used include those described in U.S. Pat. No. 7,851,188, which is incorporated herein by reference. In one embodiment, the isobutanol biosynthetic pathway comprises the following substrate to product conversions:
  a) pyruvate to acetolactate, which may be catalyzed, for example, by acetolactate synthase;
  b) acetolactate to 2,3-dihydroxyisovalerate, which may be catalyzed, for example, by acetohydroxy acid reductoisomerase;

c) 2,3-dihydroxyisovalerate to α-ketoisovalerate, which may be catalyzed, for example, by acetohydroxy acid dehydratase;

d) α-ketoisovalerate to isobutyraldehyde, which may be catalyzed, for example, by a branched-chain keto acid decarboxylase; and, e) isobutyraldehyde to isobutanol, which may be catalyzed, for example, by a branched-chain alcohol dehydrogenase.

In another embodiment, the isobutanol biosynthetic pathway comprises the following substrate to product conversions:

a) pyruvate to acetolactate, which may be catalyzed, for example, by acetolactate synthase;

b) acetolactate to 2,3-dihydroxyisovalerate, which may be catalyzed, for example, by ketol-acid reductoisomerase;

c) 2,3-dihydroxyisovalerate to α-ketoisovalerate, which may be catalyzed, for example, by dihydroxyacid dehydratase;

d) α-ketoisovalerate to valine, which may be catalyzed, for example, by transaminase or valine dehydrogenase;

e) valine to isobutylamine, which may be catalyzed, for example, by valine decarboxylase;

f) isobutylamine to isobutyraldehyde, which may be catalyzed by, for example, omega transaminase; and, g) isobutyraldehyde to isobutanol, which may be catalyzed, for example, by a branched-chain alcohol dehydrogenase.

In another embodiment, the isobutanol biosynthetic pathway comprises the following substrate to product conversions:

a) pyruvate to acetolactate, which may be catalyzed, for example, by acetolactate synthase;

b) acetolactate to 2,3-dihydroxyisovalerate, which may be catalyzed, for example, by acetohydroxy acid reductoisomerase;

c) 2,3-dihydroxyisovalerate to α-ketoisovalerate, which may be catalyzed, for example, by acetohydroxy acid dehydratase;

d) α-ketoisovalerate to isobutyryl-CoA, which may be catalyzed, for example, by branched-chain keto acid dehydrogenase;

e) isobutyryl-CoA to isobutyraldehyde, which may be catalyzed, for example, by acetylating aldehyde dehydrogenase; and, f) isobutyraldehyde to isobutanol, which may be catalyzed, for example, by a branched-chain alcohol dehydrogenase.

Figure 8:
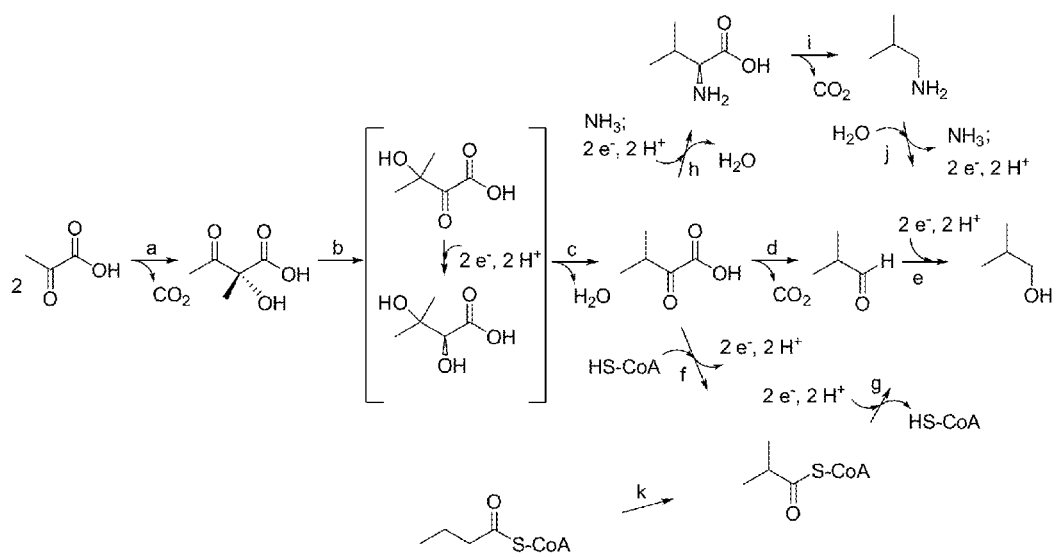
FIG. 8 depicts different isobutanol biosynthetic pathways. The steps labeled "a", "b", "c", "d", "e", "f", "g", "h", "i", "j", and "k" represent substrate to product conversions described below. "a" may be catalyzed, for example, by acetolactate synthase. "b" may be catalyzed, for example, by acetohydroxyacid reductoisomerase. "c" may be catalyzed, for example, by acetohydroxy acid dehydratase. "d" may be catalyzed, for example, by branched-chain keto acid decarboxylase. "e" may be catalyzed, for example, by branched chain alcohol dehydrogenase. "f" may be catalyzed, for example, by branched chain keto acid dehydrogenase. "g" may be catalyzed, for example, by acetylating aldehyde dehydrogenase. "h" may be catalyzed, for example, by transaminase or valine dehydrogenase. "i" may be catalyzed, for example, by valine decarboxylase. "j" may be catalyzed, for example, by omega transaminase.

In another embodiment, the isobutanol biosynthetic pathway comprises the substrate to product conversions shown as steps k, g, and e in FIG. 8.

Biosynthetic pathways for the production of 1-butanol that may be used include those described in U.S. Appl. Pub. No. 2008/0182308, which is incorporated herein by reference. In one embodiment, the 1-butanol biosynthetic pathway comprises the following substrate to product conversions:

a) acetyl-CoA to acetoacetyl-CoA, which may be catalyzed, for example, by acetyl-CoA acetyl transferase;

b) acetoacetyl-CoA to 3-hydroxybutyryl-CoA, which may be catalyzed, for example, by 3-hydroxybutyryl-CoA dehydrogenase;

c) 3-hydroxybutyryl-CoA to crotonyl-CoA, which may be catalyzed, for example, by crotonase;

d) crotonyl-CoA to butyryl-CoA, which may be catalyzed, for example, by butyryl-CoA dehydrogenase;

e) butyryl-CoA to butyraldehyde, which may be catalyzed, for example, by butyraldehyde dehydrogenase; and, f) butyraldehyde to 1-butanol, which may be catalyzed, for example, by butanol dehydrogenase.

Biosynthetic pathways for the production of 2-butanol that may be used include those described in U.S. Appl. Pub. No. 2007/0259410 and U.S. Appl. Pub. No. 2009/0155870, which are incorporated herein by reference. In one embodiment, the 2-butanol biosynthetic pathway comprises the following substrate to product conversions:

a) pyruvate to alpha-acetolactate, which may be catalyzed, for example, by acetolactate synthase;

b) alpha-acetolactate to acetoin, which may be catalyzed, for example, by acetolactate decarboxylase;

c) acetoin to 3-amino-2-butanol, which may be catalyzed, for example, acetonin aminase;

d) 3-amino-2-butanol to 3-amino-2-butanol phosphate, which may be catalyzed, for example, by aminobutanol kinase;

e) 3-amino-2-butanol phosphate to 2-butanone, which may be catalyzed, for example, by aminobutanol phosphate phosphorylase; and, f) 2-butanone to 2-butanol, which may be catalyzed, for example, by butanol dehydrogenase.

In another embodiment, the 2-butanol biosynthetic pathway comprises the following substrate to product conversions:

a) pyruvate to alpha-acetolactate, which may be catalyzed, for example, by acetolactate synthase;

b) alpha-acetolactate to acetoin, which may be catalyzed, for example, by acetolactate decarboxylase;

c) acetoin to 2,3-butanediol, which may be catalyzed, for example, by butanediol dehydrogenase;

d) 2,3-butanediol to 2-butanone, which may be catalyzed, for example, by dial dehydratase; and, e) 2-butanone to 2-butanol, which may be catalyzed, for example, by butanol dehydrogenase.

Biosynthetic pathways for the production of 2-butanone that may be used include those described in U.S. Appl. Pub. No. 2007/0259410 and U.S. Appl. Pub. No. 2009/0155870, which are incorporated herein by reference. In one embodiment, the 2-butanone biosynthetic pathway comprises the following substrate to product conversions:

a) pyruvate to alpha-acetolactate, which may be catalyzed, for example, by acetolactate synthase;

b) alpha-acetolactate to acetoin, which may be catalyzed, for example, by acetolactate decarboxylase;

c) acetoin to 3-amino-2-butanol, which may be catalyzed, for example, acetonin aminase;

d) 3-amino-2-butanol to 3-amino-2-butanol phosphate, which may be catalyzed, for example, by aminobutanol kinase; and, e) 3-amino-2-butanol phosphate to 2-butanone, which may be catalyzed, for example, by aminobutanol phosphate phosphorylase.

In another embodiment, the 2-butanone biosynthetic pathway comprises the following substrate to product conversions:

a) pyruvate to alpha-acetolactate, which may be catalyzed, for example, by acetolactate synthase;

b) alpha-acetolactate to acetoin which may be catalyzed, for example, by acetolactate decarboxylase;

c) acetoin to 2,3-butanediol, which may be catalyzed, for example, by butanediol dehydrogenase;

d) 2,3-butanediol to 2-butanone, which may be catalyzed, for example, by diol dehydratase.

One embodiment of the invention is directed to an isolated polynucleotide comprising:
(a) a promoter nucleic acid sequence; and
(b) a nucleic acid sequence encoding a biocatalyst polypeptide; wherein the nucleic acid sequence of (b) is coupled to the nucleic acid sequence of (a) such that the biocatalyst polypeptide is preferentially expressed during a production phase of fermentation. In one embodiment, the biocatalyst polypeptide catalyzes the conversion of a substrate to product in a butanol or 2-butanone biosynthesis pathway.

Another embodiment of the invention is directed to an isolated polynucleotide comprising:
(a) a promoter nucleic acid sequence; and
(b) a nucleic acid sequence encoding a biocatalyst polypeptide; wherein the nucleic acid sequence of (b) is coupled to the nucleic acid sequence of (a) such that the expression of the biocatalyst polypeptide is preferentially inhibited during a propagation phase.

In another embodiment, the biocatalyst polypeptide comprises or is selected from the group of enzymes having the following Enzyme Commission Numbers: EC 2.2.1.6, EC 1.1.1.86, EC 4.2.1.9, EC 4.1.1.72, EC 1.1.1.1, EC 1.1.1.265, EC 1.1.1.2, EC 1.2.4.4, EC 1.3.99.2, EC 1.2.1.57, EC 1.2.1.10, EC 2.6.1.66, EC 2.6.1.42, EC 1.4.1.9, EC 1.4.1.8, EC 4.1.1.14, EC 2.6.1.18, EC 2.3.1.9, EC 2.3.1.16, EC 1.1.130, EC 1.1.1.35, EC 1.1.1.157, EC 1.1.136, EC 4.2.1.17, EC 4.2.1.55, EC 1.3.1.44, EC 1.3.1.38, EC 1.3.1.44, EC 1.3.1.38, EC 5.4.99.13, EC 4.1.1.5, EC 1.1.1.1, 2.7.1.29, 1.1.1.76, and 4.2.1.28, or the enzymes acetonin aminase, acetoin phosphate aminase, aminobutanol phosphate phospholyase, and aminobutanol kinase.

In some embodiments, the biocatalyst polypeptide which catalyzes the substrate to product conversions of acetolactate to 2,3-dihydroxyisovalerate and/or the polypeptide catalyzing the substrate to product conversion of isobutyraldehyde to isobutanol utilize NADH as a cofactor.

In some embodiments, enzymes from the biosynthetic pathway are localized to the cytosol. In some embodiments, enzymes from the biosynthetic pathway that are usually localized to the mitochondria are localized to the cytosol. In some embodiments, an enzyme from the biosynthetic pathway is localized to the cytosol by removing the mitochondrial targeting sequence. In some embodiments, mitochondrial targeting is eliminated by generating new start codons as described in U.S. Pat. No. 7,851,188, which is incorporated herein by reference in its entirety.

In some embodiments, the biocatalyst polypeptide is KARI. In some embodiments, KARI preferentially utilizes NADH as a cofactor. In some embodiments, the biocatalyst polypeptide is ADH. In some embodiments, ADH preferentially utilizes NADH as a cofactor.

In some embodiments, the biocatalyst polypeptide is KIVD, is some embodiments, the biocatalyst polypeptide is DHAD. In some embodiments, the biocatalyst polypeptide is ALS.

Genes and polypeptides that can be used for the substrate to product conversions described above as well as those for additional isobutanol pathways, are described herein and in the art, for example, in U.S. Patent Appl. Pub. No. 20070092957, PCT Pub. No. WO 2011/019894, and in PCT App. No. WO2012/129555, all incorporated by reference herein. US Appl. Pub. Nos. 2011/019894, 20070092957, 20100081154, describe dihydroxyacid dehydratases including those from *Lactococcus lactis* (SEQ ID NO: 794) and *Streptococcus mutans* (SEQ ID NO: 793) and variants thereof, eg. *S. mutans* 12V5 (SEQ ID NO: 792). Ketoisovalerate decarboxylases include those derived from *Lactococcus lactis* (SEQ ID NO: 795), *Macrococcus caseolyticus* (SEQ ID NO: 797) and *Listeria grayi* (SEQ ID NO: 796). U.S. Patent Appl. Publ. No. 2009/0269823 and U.S. Appl. Publ. No. 20110269199, incorporated by reference, describe alcohol dehydrogenases. Alcohol dehydrogenases include SadB from *Achromobacter xylosoxidans* (SEQ ID NO: 798) disclosed in U.S. Pat. No. 8,188,250, incorporated herein by reference. Additional alcohol dehydrogenases include horse liver ADH (SEQ ID NO: 799) and *Beijerinkia indica* ADH (SEQ ID NO: 800), and those that utilize NADH as a cofactor. KARI enzymes are described for example, in U.S. Pat. Nos. 7,910,342 and 8,129,162; U.S. Publication No. 2010/0197519; International Publication No. WO 2012/129555, all of which are incorporated by reference. KARIs include *Pseudomonas fluorescens* KARI (SEQ ID NO: 801) and variants thereof and *Anaerostipes caccae* KARI (SEQ ID NO: 802) and variants thereof (eg. "K9G9", "K9D3", and "K9JB4P"; SEQ ID NOs: 167, 166, and 791 respectively). In one embodiment a butanol biosynthetic pathway comprises a) a ketol-acid reductoisomerase that has a KM for NADH less than about 300 µM, less than about 100 µM, less than about 50 µM, less than about 20 µM or less than about 10 µM; b) an alcohol dehydrogenase that utilizes NADH as a cofactor; or c) both a) and b).

Cell Integrity Polypeptides

Another embodiment of the invention is directed to an isolated polynucleotide comprising: (a) a promoter nucleic acid sequence; and (b) a nucleic acid sequence encoding a biocatalyst polypeptide for cell integrity. In embodiments, the nucleic acid sequence of (b) is coupled to the nucleic acid sequence of (a) such that the polypeptide necessary for cell integrity is preferentially expressed during the production phase of fermentation.

In one embodiment, the biocatalyst polypeptide is a GPI-anchored cell wall protein involved in acid resistance. In one embodiment, the biocatalyst polypeptide is YER150W (SPI1) (nucleic acid SEQ ID NO: 190; amino acid SEQ ID NO: 397), or a homolog thereof. In another embodiment, the biocatalyst polypeptide is encoded by a cell wall integrity gene activated by Rlm1 such as a polypeptide listed in Table 5 or a homolog thereof

TABLE 5

Biocatalyst polypeptides for cell integrity

| Gene ID | Other name | Nucleic acid SEQ ID NO: | Amino acid SEQ ID NO: |
| --- | --- | --- | --- |
| YDR055W | PST1 | 398 | 399 |
| YDR077W | SED1 | 400 | 401 |
| YGR189C | CRH1 | 402 | 403 |
| YKL096W | CWP1 | 404 | 405 |
| YLR194C |  | 207 | 407 |
| YKL164C | PIR1 | 408 | 409 |
| YJL159W | HSP150 | 410 | 411 |
| YKL163W | PIR3 | 412 | 413 |
| YKL158C | CIS3 | 414 | 415 |
| YGR282C | BGL2 | 416 | 417 |
| YHR030C | SLT2 | 418 | 419 |
| YKL161C | KDX1 | 420 | 421 |
| YLR342W | FKS1 | 422 | 423 |
| YGR032W | FKS2 | 216 | 425 |
| YBR023C | CHS3 | 426 | 427 |
| YIL076W | SEC28 | 428 | 429 |
| YMR238W | DFG5 | 430 | 431 |
| YIL117C | PRM5 | 432 | 433 |
| YNL058C |  | 434 | 435 |

In embodiments, cell integrity polypeptides are preferentially expressed during the production phase. While not wishing to be bound by theory, it is believed that expression of such polypeptides may contribute to improved tolerance of a host cell to a fermentation product (eg. butanol), thus improving production.

Propagation Polypeptides

Another embodiment of the invention is directed to an isolated polynucleotide comprising:
(a) a promoter nucleic acid sequence; and
(b) a nucleic acid sequence encoding a biocatalyst polypeptide necessary for cell propagation; wherein the nucleic acid sequence of (b) is coupled to the nucleic acid sequence of (a) such that the expression of the propagation polypeptide is higher during the propagation phase of fermentation rather than the production phase.

In some embodiments, the propagation polypeptide is phosphoketolase. In some embodiments, the propagation polypeptide is phosphotransacetylase. Example phosphoketolases and phosphotransacetylases are described in PCT Publication No. WO/2011/159853 and U.S. App. Pub. No. 20120156735A1, herein incorporated by reference. In some embodiments, the phosphoketolase is xpk from *Lactobacillus plantarum* (nucleic acid SEQ ID NO: 180; amino acid SEQ ID NO: 181). In some embodiments, the phosphotransacetylase is eutD from *Lactobacillus plantarum* (nucleic acid SEQ ID NO: 178; amino acid SEQ ID NO: 179).

In embodiments, host cells comprising such nucleic acid sequences encoding biocatalyst polypeptides for cell propagation have reduced or eliminated pyruvate decarboxylase activity.

Biosynthetic Pathway by-Product Producing Polypeptides

DHMB can be produced as a result of a side-reaction that occurs when host cells are genetically manipulated to include a biosynthetic pathway, e.g., a biosynthetic pathway that involves the production of acetolactate. The presence of DHMB indicates that not all of the pathway substrates are being converted to the desired product. Thus, yield may be lowered. In addition, DHMB present in the fermentation media may have inhibitory effects on product production. For example, DHMB can decrease the activity of enzymes in the biosynthetic pathway or have other inhibitory effects on cell growth and/or productivity during fermentation. Thus, described herein are isolated polynucleotides resulting in lower expression of DHMB during the production phase of fermentation than in the propagation phase. The ability of a host cell to convert acetolactate to DHMB can be reduced or eliminated, for example, by reducing the expression of a polypeptide having acetolactate reductase activity. In some embodiments, the polypeptide having acetolactate reductase activity is YMR226C (nucleic acid SEQ ID NO: 182, amino acid SEQ ID NO: 183) or a homolog thereof.

The last step in the biosynthesis of isobutanol via a pyruvate-utilizing biosynthetic pathway is the conversion of isobutyraldehyde to isobutanol (FIG. 8). A side reaction in this pathway is the conversion of isobutyraldehyde to isobutyric acid which results in reduced amounts of isobutyraldehyde available to convert into isobutanol and reduced isobutanol yield. Reducing or eliminating the conversion of isobutyraldehyde to isobutyric acid may result in increased amounts of isobutyraldehyde available for conversion to isobutanol. The conversion of isobutyraldehyde to isobutanol can be reduced or eliminated, for example, by reducing the expression of an aldehyde dehydrogenase. Thus, provided herein are isolated polynucleotides resulting in lower expression of an aldehyde dehydrogenase during the production phase of fermentation than in the propagation phase. In embodiments, a recombinant host cell of the invention can be *S. cerevisiae*, and a polypeptide having aldehyde dehydrogenase activity can be ALD2 (nucleic acid SEQ ID NO: 436; amino acid SEQ ID NO: 437), ALD3 (nucleic acid SEQ ID NO: 438; amino acid SEQ ID NO: 439), ALD4 (nucleic acid SEQ ID NO: 440; amino acid SEQ ID NO: 441), ALD5 (nucleic acid SEQ ID NO: 442; amino acid SEQ ID NO: 443), ALD6 (nucleic acid SEQ ID NO: 184; amino acid SEQ ID NO: 185), or combinations thereof. In other embodiments, a recombinant host cell can be *Kluyveromyces lactis*, and a polypeptide having aldehyde dehydrogenase activity can be KLLA0F00440, KLLA0E23057, KLLA0D10021, KLLA0D09999G, or combinations thereof. In other embodiments, a recombinant host cell can be *Pichia stipitis*, and a polypeptide having aldehyde dehydrogenase activity can be ALD2, ALD3, ALD4, ALD5, ALD7, or combinations thereof. In other embodiments, a recombinant host cell can be *Lactobacillus plantarum*, and a polypeptide having aldehyde dehydrogenase activity can be AldH. In other embodiments, a recombinant host cell can be *E. coli*, and a polypeptide having aldehyde dehydrogenase activity can be aldA, aldB, or combinations thereof.

Glycerol Biosynthesis Pathway Polypeptides

Endogenous NAD-dependent glycerol-3-phosphate dehydrogenase is a key enzyme in glycerol synthesis, converting dihydroxyacetone phosphate (DHAP) to glycerol-3-phosphate and playing a role in cellular oxidation of NADH. Yeast strains may have one or more genes encoding NAD-dependent glycerol-3-phosphate dehydrogenase (GPD). In some yeasts, such as *S. cerevisiae*, *S. pombe*, and *P. stipitis*, GPD1 and GPD2 are functional homologs for NAD-dependent glycerol-3-phosphate dehydrogenase. Provided herein are isolated polynucleotides that resulting in lower expression of glycerol-3-phosphate dehydrogenase activity during the production phase of fermentation than in the propagation phase. In one embodiment, the biocatalyst polypeptide is GPD1 (nucleic acid SEQ ID NO: 444; amino acid SEQ ID NO: 445) or GPD2 (nucleic acid SEQ ID NO: 446; amino acid SEQ ID NO: 447), or a homolog thereof.

Polypeptides of an NADPH Generating Pathway

In some embodiments, the biocatalyst polypeptide is an enzyme of the oxidative pentose phosphate pathway. In some embodiments, the biocatalyst polypeptide is glucose-6-phosphate dehydrogenase (ZWF1, nucleic acid SEQ ID NO: 448; amino acid SEQ ID NO: 449), 6-phosphoglucononolactonase (SOL3: nucleic acid SEQ ID NO: 450; amino acid SEQ ID NO: 451; or SOL4: SEQ ID NO: 452; amino acid SEQ ID NO: 453), or 6-phosphogluconate dehydrogenase nucleic acid (GND1: nucleic acid SEQ ID NO: 454; amino acid SEQ ID NO: 455; GND2: nucleic acid SEQ ID NO: 456; amino acid SEQ ID NO: 457). For example, in one embodiment, ZWF1 is preferentially expressed in propagation. In some embodiments, the reducing equivalents (such as NADH) produced in glycolysis are utilized by the biosynthetic production pathway during the production phase. For example, in an isobutanol biosynthetic pathway described herein, 2 molecules of NADH produced during glycolysis are consumed per molecule of isobutanol produced. While not wishing to be bound by theory, it is believed that reduced expression of ZWF1 during such production processes may result in decreased excess NADPH production and consequently decreased by-product production.

Recombinant Microbial Host Cells

Standard recombinant DNA and molecular cloning techniques are well known in the art and are described by Sambrook, J., Fritsch, E. F. and Maniatis, T., *Molecular Cloning: A Laboratory Manual*, Second Edition, Cold Spring Harbor Laboratory Press, Cold Spring Harbor, N.Y. (1989) (hereinafter "Maniatis"); and by Silhavy, T. J., Bennan, M. L. and Enquist, L. W., *Experiments with Gene Fusions*, Cold Spring Harbor Laboratory Press, Cold Spring Harbor, N.Y. (1984); and by Ausubel, F. M. et al., *Current Protocols in Molecular Biology*, published by Greene Publishing Assoc. and Wiley-Interscience (1987). Additional methods are in *Methods in Enzymology*, Volume 194, *Guide to Yeast Genetics and Molecular and Cell Biology* (Part A, 2004, Christine Guthrie and Gerald R. Fink (Eds.), Elsevier Academic Press, San Diego, Calif.). Molecular tools and techniques are known in the art and include splicing by overlapping extension polymerase chain reaction (PCR) (Yu, et al. (2004) Fungal Genet. Biol. 41:973-981), positive selection for mutations at the URA3 locus of *Saccharomyces cerevisiae* (Boeke, J. D. et al. (1984) Mol. Gen. Genet. 197, 345-346; M A Romanos, et al. Nucleic Acids Res. 1991 Jan. 11; 19(1): 187), the cre-lox site-specific recombination system as well as mutant lox sites and FLP substrate mutations (Sauer, B. (1987) Mol Cell Biol 7: 2087-2096; Senecoff, et al. (1988) Journal of Molecular Biology, Volume 201, Issue 2, Pages 405-421; Albert, et al. (1995) The Plant Journal. Volume 7, Issue 4, pages 649-659), "seamless" gene deletion (Akada, et al. (2006) Yeast; 23(5): 399-405), and gap repair methodology (Ma et al., *Genetics* 58:201-216; 1981).

The genetic manipulations of a recombinant host cell disclosed herein can be performed using standard genetic techniques and screening and can be made in any host cell that is suitable to genetic manipulation (*Methods in Yeast Genetics*, 2005, Cold Spring Harbor Laboratory Press, Cold Spring Harbor, N.Y., pp. 201-202).

Non-limiting examples of host cells for use in the invention include bacteria, cyanobacteria, filamentous fungi and yeasts.

In one embodiment, the recombinant host cell of the invention is a bacterial or a cyanobacterial cell. In another embodiment, the recombinant host cell comprises or is selected from the group consisting of: *Salmonella, Arthrobacter, Bacillus, Brevibacterium, Clostridium, Corynebacterium, Gluconobacter, Nocardia, Pseudomonas, Rhodococcus, Streptomyces, Zymomonas, Escherichia, Lactobacillus, Enterococcus, Alcaligenes, Klebsiella, Serratia, Shigella, Alcaligenes, Erwinia, Paenibacillus,* and *Xanthomonas*. In some embodiments, the recombinant host cell is *E. coli, S. cerevisiae*, or *L. plantarum*.

In another embodiment, the recombinant host cell of the invention is a filamentous fungi or yeast cell. In another embodiment, the recombinant host cell comprises or is selected from the group consisting of: *Saccharomyces, Pichia, Hansenula, Yarrowia, Aspergillus, Kluyveromyces, Pachysolen, Rhodotorula, Zygosaccharomyces, Galactomyces, Schizosaccharomyces, Torulaspora, Debayomyces, Williopsis, Dekkera, Kloeckera, Metschnikowia*, and *Candida*. In another embodiment, the host cell does not express an enzyme or has reduced expression of an enzyme having the following Enzyme Commission Number: EC 4.1.1.1.

In some embodiments, the yeast is crabtree-positive. Crabtree-positive yeast cells demonstrate the crabtree effect, which is a phenomenon whereby cellular respiration is inhibited when a high concentration of glucose is present in aerobic culture medium. Suitable crabtree-positive yeast are viable in culture and include, but are not limited to, *Saccharomyces, Schizosaccharomyces*, and *Issatchenkia*. Suitable species include, but are not limited to, *Saccharomyces cerevisiae, Schizosaccharomyces pombe, Kluyveromyces thermotolerans, Candida glabrata, Issatchenkia orientalis*.

Crabtree-positive yeast cells may be grown with high aeration and in low glucose concentration to maximize respiration and cell mass production, as known in the art, rather than butanol production. Typically the glucose concentration is kept to less than about 0.2 g/L. The aerated culture can grow to a high cell density and then be used as the present production culture. Alternatively, yeast cells that are capable of producing butanol may be grown and concentrated to produce a high cell density culture.

In some embodiments, the yeast is crabtree-negative. Crabtree-negative yeast cells do not demonstrate the crabtree effect when a high concentration of glucose is added to aerobic culture medium, and therefore, in crabtree-negative yeast cells, alcoholic fermentation is absent after an excess of glucose is added. Suitable Crabtree-negative yeast genera are viable in culture and include, but are not limited to, *Hansenula, Debaryomyces, Yarrowia, Rhodotorula*, and *Pichia*. Suitable species include, but are not limited to, *Candida utilis, Hansenula nonfermentans, Kluyveromyces marxianus, Kluyveromyces lactis, Pichia stipitis*, and *Pichia pastoris*.

Suitable microbial hosts include, but are not limited to, members of the genera *Clostridium, Zymomonas, Escherichia, Salmonella, Rhodococcus, Pseudomonas, Bacillus, Vibrio, Lactobacillus, Enterococcus, Alcaligenes, Klebsiella, Paenibacillus, Arthrobacter, Corynebacterium, Brevibacterium, Pichia, Candida, Issatchenkia, Hansenula, Kluyveromyces,* and *Saccharomyces*. Suitable hosts include: *Escherichia coli, Alcaligenes eutrophus, Bacillus licheniformis, Paenibacillus macerans, Rhodococcus erythropolis, Pseudomonas putida, Lactobacillus plantarum, Enterococcus faecium, Enterococcus gallinarium, Enterococcus faecalis, Bacillus subtilis* and *Saccharomyces cerevisiae*. In some embodiments, the host cell is *Saccharomyces cerevisiae*. *S. cerevisiae* yeast are known in the art and are available from a variety of sources, including, but not limited to, American Type Culture Collection (Rockville, Md.), Centraalbureau voor Schimmelcultures (CBS) Fungal Biodiversity Centre, LeSaffre, Gert Strand AB, Ferm Solutions, North American Bioproducts, Martrex, and Lallemand. *S. cerevisiae* include, but are not limited to, BY4741, CEN.PK 113-7D, Ethanol Red® yeast, Ferm Pro™ yeast, Bio-Ferm® XR yeast, Gert Strand Prestige Batch Turbo alcohol yeast, Gert Strand Pot Distillers yeast, Gert Strand Distillers Turbo yeast, FerMax™ Green yeast, FerMax™ Gold yeast, Thermosacc® yeast, BG-1, PE-2, CAT-1, CBS7959, CBS7960, and CBS7961.

Recombinant microorganisms containing the necessary genes that will encode the enzymatic pathway for the conversion of a fermentable carbon substrate to a desired product (eg. butanol) can be constructed using techniques well known in the art. For example, genes encoding the enzymes of one of the isobutanol biosynthetic pathways of the invention, for example, acetolactate synthase, acetohydroxy acid isomeroreductase, acetohydroxy acid dehydratase, branched-chain α-keto acid decarboxylase, and branched-chain alcohol dehydrogenase, can be obtained from various sources, as described above.

Methods of obtaining desired genes from a genome are common and well known in the art of molecular biology. For example, if the sequence of the gene is known, suitable genomic libraries can be created by restriction endonuclease digestion and can be screened with probes complementary to the desired gene sequence. Once the sequence is isolated, the DNA can be amplified using standard primer-directed amplification methods such as polymerase chain reaction (U.S. Pat. No. 4,683,202) to obtain amounts of DNA suitable for transformation using appropriate vectors. Tools for codon optimization for expression in a heterologous host are readily available (described elsewhere herein).

Once the relevant pathway genes are identified and isolated they can be transformed into suitable expression hosts by means well known in the art. Vectors or cassettes useful for the transformation of a variety of host cells are common and commercially available from companies such as EPICENTRE® (Madison, Wis.), Invitrogen Corp. (Carlsbad, Calif.), Stratagene (La Jolla, Calif.), and New England Biolabs, Inc. (Beverly, Mass.). Typically the vector or cassette contains sequences directing transcription and translation of the relevant gene, a selectable marker, and sequences allowing autonomous replication or chromosomal integration. Suitable vectors comprise a region 5' of the gene which harbors transcriptional initiation controls and a region 3' of the DNA fragment which controls transcriptional termination. Both control regions can be derived from genes homologous to the transformed host cell, although it is to be understood that such control regions can also be derived from genes that are not native to the specific species chosen as a production host.

Initiation control regions or promoters, which are useful to drive expression of the relevant pathway coding regions in the desired host cell are numerous and familiar to those skilled in the art. Virtually any promoter capable of driving these genetic elements, including those used in the Examples, is suitable for the present invention including, but not limited to, CYC1, HIS3, GAL1, GAL10, ADH1, PGK, PHO5, GAPDH, ADC1, TRP1, URA3, LEU2, ENO, TPI (useful for expression in *Saccharomyces*); AOX1 (useful for expression in *Pichia*); and lac, ara, tet, trp, $1P_L$, $1P_R$, T7, tac, and trc (useful for expression in *Escherichia coli, Alcaligenes*, and *Pseudomonas*) as well as the amy, apr, npr promoters and various phage promoters useful for expression in *Bacillus subtilis, Bacillus licheniformis*, and *Paenibacillus macerans*. For yeast recombinant host cells, a number of promoters can be used in constructing expression cassettes for genes, including, but not limited to, the following constitutive promoters suitable for use in yeast: FBA1, TDH3 (GPD), ADH1, ILV5, and GPM1; and the following inducible promoters suitable for use in yeast: GAL1, GAL10, OLE1, and CUP1. Other yeast promoters include hybrid promoters UAS(PGK1)-FBA1p, UAS(PGK1)-ENO2p, UAS(FBA1)-PDC1p, UAS(PGK1)-PDC1p, and UAS(PGK)-OLE1p.

Promoters, transcriptional terminators, and coding regions can be cloned into a yeast 2 micron plasmid and transformed into yeast cells (Ludwig, et al. Gene, 132: 33-40, 1993; US Appl. Pub. No. 20080261861A1).

Adjusting the amount of gene expression in a given host may be achieved by varying the level of transcription, such as through selection of native or artificial promoters. In addition, techniques such as the use of promoter libraries to achieve desired levels of gene transcription are well known in the art. Such libraries can be generated using techniques known in the art, for example, by cloning of random cDNA fragments in front of gene cassettes (Goh et al. (2002) AEM 99, 17025), by modulating regulatory sequences present within promoters (Ligr et al. (2006) Genetics 172, 2113), or by mutagenesis of known promoter sequences (Alper et al. (2005) PNAS, 12678; Nevoigt et al. (2006) AEM 72, 5266).

Termination control regions can also be derived from various genes native to the hosts. Optionally, a termination site can be unnecessary or can be included.

Certain vectors are capable of replicating in a broad range of host bacteria and can be transferred by conjugation. The complete and annotated sequence of pRK404 and three related vectors-pRK437, pRK442, and pRK442(H) are available. These derivatives have proven to be valuable tools for genetic manipulation in Gram-negative bacteria (Scott et al., Plasmid, 50: 74-79, 2003). Several plasmid derivatives of broad-host-range Inc P4 plasmid RSF1010 are also available with promoters that can function in a range of Gram-negative bacteria. Plasmid pAYC36 and pAYC37, have active promoters along with multiple cloning sites to allow for the heterologous gene expression in Gram-negative bacteria.

Chromosomal gene replacement tools are also widely available. For example, a thermosensitive variant of the broad-host-range replicon pWV101 has been modified to construct a plasmid pVE6002 which can be used to effect gene replacement in a range of Gram-positive bacteria (Maguin et al., J. Bacteriol., 174: 5633-5638, 1992). Additionally, in vitro transposomes are available to create random mutations in a variety of genomes from commercial sources such as EPICENTRE®.

The expression of a biosynthetic pathway in various microbial hosts is described in more detail in the Examples herein and in the art. U.S. Pat. No. 7,851,188 and PCT App. No. WO2012/129555, both incorporated by reference, which disclose the engineering of recombinant microorganisms for production of isobutanol. U.S. Appl. Pub. No. 2008/0182308A1, incorporated by reference, discloses the engineering of recombinant microorganisms for production of 1-butanol. U.S. Appl. Pub. Nos. 2007/0259410A1 and 2007/0292927A1, both incorporated by reference, disclose the engineering of recombinant microorganisms for production of 2-butanol. Multiple pathways are described for biosynthesis of isobutanol and 2-butanol. The methods disclosed in these publications can be used to engineer the recombinant host cells of the present invention. The information presented in these publications is hereby incorporated by reference in its entirety.

Modifications

In some embodiments, the host cells comprising a biosynthetic pathway as provided herein may further comprise one or more additional modifications. U.S. Appl. Pub. No. 2009/0305363 (incorporated herein by reference) discloses increased conversion of pyruvate to acetolactate by engineering yeast for expression of a cytosol-localized acetolactate synthase and substantial elimination of pyruvate decarboxylase activity. Modifications to reduce glycerol-3-phosphate dehydrogenase activity and/or disruption in at least one gene encoding a polypeptide having pyruvate decarboxylase activity or a disruption in at least one gene encoding a regulatory element controlling pyruvate decarboxylase gene expression as described in U.S. Appl. Pub. No. 2009/0305363 (incorporated herein by reference), modifications to a host cell that provide for increased carbon flux through an Entner-Doudoroff Pathway or reducing equivalents balance as described in U.S. Appl. Pub. No. 2010/0120105 (incorporated herein by reference). Other modifications include integration of at least one polynucleotide encoding a polypeptide that catalyzes a step in a pyruvate-utilizing biosynthetic pathway. Other modifications are described in PCT. Pub. No. WO2012/129555, incorporated herein by reference. Modifications include at least one deletion, mutation, and/or substitution in an endogenous polynucleotide encoding a polypeptide having acetolactate reductase activity. In embodiments, the polypeptide having acetolactate reductase activity is YMR226C of *Saccharomyces cerevisae* or a homolog thereof. Additional modifications include a deletion, mutation, and/or substitution in an endogenous polynucleotide encoding a polypeptide having aldehyde dehydrogenase and/or aldehyde oxidase activity. In embodiments, the polypeptide having aldehyde dehydrogenase activity is ALD6 from *Saccharomyces cerevisiae* or a homolog thereof. A genetic modification which has the effect of reducing glucose repression wherein the yeast production host cell is pdc− is described in U.S. Appl. Pub. No. 2011/0124060, incorporated herein by reference. In some embodiments, the pyruvate decarboxylase that is deleted or downregulated is selected from the group consisting of: PDC1, PDC5, PDC6, or combinations thereof. In some embodiments, host cells contain a deletion or downregulation of a polynucleotide encoding a polypeptide that catalyzes the conversion of glyceraldehyde-3-phosphate to glycerate 1,3, bisphosphate. In some embodiments, the enzyme that catalyzes this reaction is glyceraldehyde-3-phosphate dehydrogenase.

Recombinant host cells may further comprise (a) at least one heterologous polynucleotide encoding a polypeptide having dihydroxy-acid dehydratase activity; and (b)(i) at least one deletion, mutation, and/or substitution in an endogenous gene encoding a polypeptide affecting Fe—S cluster biosynthesis; and/or (ii) at least one heterologous polynucleotide encoding a polypeptide affecting Fe—S cluster biosynthesis, described in PCT Publication No. WO2011/103300, incorporated herein by reference. In embodiments, the polypeptide affecting Fe—S cluster biosynthesis is encoded by AFT1, AFT2, FRA2, GRX3, or CCC1. In embodiments, the polypeptide affecting Fe—S cluster biosynthesis is constitutive mutant AFT1 L99A, AFT1 L102A, AFT1 C291F, or AFT1 C293F.

Differential Expression

As demonstrated in the Examples, a recombinant host cell comprising promoter nucleic acid sequences may be subjected to different conditions, such as conditions corresponding to those in a propagation vs. a production phase, and differential expression of a target polynucleotide or its encoded polypeptide may be confirmed using methods known in the art and/or provided herein. Differential expression of a polynucleotide encoding a biocatalyst polypeptide can be confirmed by comparing transcript levels under different conditions using reverse transcriptase polymerase chain reaction (RT-PCR) or real-time PCR using methods known in the art and/or exemplified herein. In some embodiments, a reporter, such as green fluorescent protein (GFP) can be used in combination with flow cytometry to confirm the capability of a promoter nucleic acid sequence to affect expression under different conditions. Furthermore, as demonstrated in the Examples, the activity of a biocatalyst polypeptide may be determined under different conditions to confirm the differential expression of the polypeptide. For example, where ALS is the biocatalyst polypeptide, the activity of ALS present in host cells subjected to different conditions may be determined (using, for example, methods described in W. W. Westerfeld (1945), J. Biol. Chem. 161:495-502, modified as described in the Examples herein). A difference in ALS activity can be used to confirm differential expression of the ALS. It is also envisioned that differential expression of a biocatalyst polypeptide can be confirmed indirectly by measurement of downstream products or byproducts. For example, a decrease in production of isobutyraldehyde may be indicative of differential ALS expression.

It will be appreciated that other useful methods to confirm differential expression include measurement of biomass and/or measurement of biosynthetic pathway products under different conditions. For example, spectrophotometric measurement of optical density (O.D.) can be used as an indicator of biomass. Measurement of pathway products or by-products, including, but not limited to butanol concentration, DHMB concentration, or isobutyric acid can be carried out using methods known in the art and/or provided herein such as high pressure liquid chromatography (HPLC; for example, see PCT. Pub. No. WO2012/129555, incorporated herein by reference) Likewise, the rate of biomass increase, the rate of glucose consumption, or the rate of butanol production can be determined, for example by using the indicated methods. Biomass yield and product (eg. butanol) yield can likewise be determined using methods disclosed in the art and/or herein.

Methods for Producing Fermentation Products

Another embodiment of the present invention is directed to methods for producing various fermentation products including, but not limited to, lower alkyl alcohols. These methods employ the recombinant host cells of the invention. In one embodiment, the method of the present invention comprises providing a recombinant host cell as discussed above, contacting the recombinant host cell with a fermentable carbon substrate in a fermentation medium under conditions whereby the fermentation product is produced and, optionally, recovering the fermentation product.

It will be appreciated that a process for producing fermentation products may comprise multiple phases. For example, process may comprise a first biomass production phase, a second biomass production phase, a fermentation production phase, and an optional recovery phase. In embodiments, processes provided herein comprise more than one, more than two, or more than three phases. It will be appreciated that process conditions may vary from phase to phase. For example, one phase of a process may be substantially aerobic, while the next phase may be substantially anaerobic. Other differences between phases may include, but are not limited to, source of carbon substrate (eg. feedstock from which the fermentable carbon is derived), carbon substrate (eg. glucose) concentration, dissolved oxygen, pH, temperature, or concentration of fermentation product (eg. butanol). Promoter nucleic acid sequences and nucleic acid sequences encoding biocatalyst polypeptides and recombinant host cells comprising such promoter nucleic acid sequences may be employed in such processes. In embodiments, a biocatalyst polypeptide is preferentially expressed in at least one phase.

The propagation phase generally comprises at least one process by which biomass is increased. In embodiments, the temperature of the propagation phase may be at least about 20, at least about 30, at least about 35, or at least about 40° C. In embodiments, the pH in the propagation phase may be at least about 4, at least about 5, at least about 5.5, at least about 6, or at least about 6.5. In embodiments, the propagation phase continues until the biomass concentration reaches at least about 5, at least about 10, at least about 15, at least about 20, at least about 30, at least about 50, at least about 70, or at least about 100 g/L. In embodiments, the average glucose or sugar concentration is about or less than about 2 g/L, about or less than about 1 g/L, about or less than about 0.5 g/L or about or less than about 0.1 g/L. In embodiments, the dissolved oxygen concentration may average as undetectable, or as at least about 10%, at least about 20%, at least about 30%, or at least about 40%.

In one non-limiting example, a stage of the propagation phase comprises contacting a recombinant yeast host cell with at least one carbon substrate at a temperature of about 30 to about 35° C. and a pH of about 4 to about 5.5, until the biomass concentration is in the range of about 20 to about 100 g/L. The dissolved oxygen level over the course of the contact may average from about 20 to 40% (0.8-3.2 ppm). The source of the carbon substrate may be molasses or corn mash, or pure glucose or other sugar, such that the glucose or sugar concentration is from about 0 to about 1 g/L over the course of the contacting or from about 0 to about 0.1 g/L. In a subsequence or alternate stage of the propagation phase, a recombinant yeast host cell may be subjected to a further process whereby recombinant yeast at a concentration of about 0.1 g/L to about 1 g/L is contacted with at least one carbon substrate at a temperature of about 25 to about 35° C. and a pH of about 4 to about 5.5 until the biomass concentration is in the range of about 5 to about 15 g/L. The dissolved oxygen level over the course of the contact may average from undetectable to about 30% (0-2.4 ppm). The source of the carbon substrate may be corn mash such that the glucose concentration averages about 2 to about 30 g/L over the course of contacting.

It will be understood that the propagation phase may comprise one, two, three, four, or more stages, and that the above non-limiting example stages may be practiced in any order or combination.

The production phase typically comprises at least one process by which a product is produced. In embodiments, the average glucose concentration during the production phase is at least about 0.1, at least about 1, at least about 5, at least about 10 g/L, at least about 30 g/L, at least about 50 g/L, or at least about 100 g/L. In embodiments, the temperature of the production phase may be at least about 20, at least about 30, at least about 35, or at least about 40° C. In embodiments, the pH in the production phase may be at least about 4, at least about 5, or at least about 5.5. In embodiments, the production phase continues until the product titer reaches at least about 10 g/L, at least about 15 g/L, at least about 20 g/L, at least about 25 g/L, at least about 30 g/L, at least about 35 g/L or at least about 40 g/L. In embodiments, the dissolved oxygen concentration may average as less than about 5%, less than about 1%, or as negligible such that the conditions are substantially anaerobic.

In one non-limiting example production phase, recombinant yeast cells at a concentration of about 0.1 to about 6 g/L are contacted with at least one carbon substrate at a concentration of about 5 to about 100 g/L, temperature of about 25 to about 30° C., pH of about 4 to about 5.5. The dissolved oxygen level over the course of the contact may be negligible on average, such that the contact occurs under substantially anaerobic conditions. The source of the carbon substrate may mash such as corn mash, such that the glucose concentration averages about 10 to about 100 g/L over the course of the contacting, until it is substantially completely consumed.

In embodiments, the glucose concentration is about 100-fold to about 1000-fold higher in the production phase than in the propagation phase. In embodiments, the glucose concentration in production is at least about 5×, at least about 10×, at least about 50×, at least about 100×, or at least about 500× higher than that in propagation. In embodiments, the temperature in the propagation phase is about 5 to about 10 degrees lower in the production phase than in the propagation phase. In embodiments, the average dissolved oxygen concentration is anaerobic in the production phase and microaerobic to aerobic in the propagation phase.

One of skill in the art will appreciate that the conditions for propagating a host cell and/or producing a fermentation product utilizing a host cell may vary according to the host cell being used. In one embodiment, the method for producing a fermentation product is performed under anaerobic conditions. In one embodiment, the method for producing a fermentation product is performed under microaerobic conditions.

Further, it is envisioned that once a recombinant host cell comprising a suitable genetic switch has been identified, the process may be further refined to take advantage of the differential expression afforded thereby. For example, if the genetic switch provides preferential expression in high glucose conditions, one of skill in the art will be able to readily determine the glucose levels necessary to maintain minimal expression. As such, the glucose concentration in the phase of the process under which minimal expression is desired can be controlled so as to maintain minimal expression. In one non-limiting example, polymer-based slow-release feed beads (available, for example, from Kuhner Shaker, Basel, Switzerland) may be used to maintain a low glucose condition. A similar strategy can be employed to refine the propagation or production phase conditions relevant to the differential expression using the compositions and methods provided herein.

Carbon substrates may include, but are not limited to, monosaccharides (such as fructose, glucose, mannose, rhamnose, xylose or galactose), oligosaccharides (such as lactose, maltose, or sucrose), polysaccharides such as starch, maltodextrin, or cellulose, fatty acids, or mixtures thereof and unpurified mixtures from renewable feedstocks such as corn mash, cheese whey permeate, cornsteep liquor, sugar beet molasses, and barley malt. Other carbon substrates may include ethanol, lactate, succinate, or glycerol.

Additionally, the carbon substrate may also be a one carbon substrate such as carbon dioxide, or methanol for which metabolic conversion into key biochemical intermediates has been demonstrated. In addition to one and two carbon substrates, methylotrophic organisms are also known to utilize a number of other carbon containing compounds such as methylamine, glucosamine and a variety of amino acids for metabolic activity. For example, methylotrophic yeasts are known to utilize the carbon from methylamine to form trehalose or glycerol (Bellion et al., Microb. Growth C1 Compd., [Int. Symp.], 7th (1993), 415 32, Editor(s): Murrell, J. Collin; Kelly, Don P. Publisher: Intercept, Andover, UK). Similarly, various species of *Candida* will metabolize alanine or oleic acid (Sulter et al., *Arch. Microbiol.* 153:485-489 (1990)). Hence, it is contemplated that the source of carbon utilized in the present invention may encompass a wide variety of carbon containing substrates and will only be limited by the choice of organism.

Although it is contemplated that all of the above mentioned carbon substrates and mixtures thereof may be suitable in the present invention, preferred carbon substrates are glucose, fructose, and sucrose, or mixtures of these with C5 sugars such as xylose and/or arabinose for yeasts cells modified to use C5 sugars. Sucrose may be derived from renewable sugar sources such as sugar cane, sugar beets, cassava, sweet sorghum, and mixtures thereof. Glucose and dextrose may be derived from renewable grain sources through saccharification of starch based feedstocks including grains such as corn, wheat, rye, barley, oats, and mixtures thereof. In addition, fermentable sugars may be derived from renewable cellulosic or lignocellulosic biomass through processes of pretreatment and saccharification, as described, for example, in U.S. Appl. Pub. No. 2007/0031918 A1, which is herein incorporated by reference. Biomass in reference to a carbon source refers to any cellulosic or lignocellulosic material and includes materials comprising cellulose, and optionally further comprising hemicellulose, lignin, starch, oligosaccharides and/or monosaccharides. Biomass may also comprise additional components, such as protein and/or lipid. Biomass may be derived from a single source, or biomass can comprise a mixture derived from more than one source; for example, biomass may comprise a mixture of corn cobs and corn stover, or a mixture of grass and leaves. Biomass includes, but is not limited to, bioenergy crops, agricultural residues, municipal solid waste, industrial solid waste, sludge from paper manufacture, yard waste, wood and forestry waste. Examples of biomass include, but are not limited to, corn grain, corn cobs, crop residues such as corn husks, corn stover, grasses, wheat, wheat straw, barley, barley straw, hay, rice straw, switchgrass, waste paper, sugar cane bagasse, sorghum, soy, components obtained from milling of grains, trees, branches, roots, leaves, wood chips, sawdust, shrubs and bushes, vegetables, fruits, flowers, animal manure, and mixtures thereof.

The carbon substrates may be provided in any media that is suitable for host cell growth and reproduction. Non-limiting examples of media that can be used include M122C, MOPS, SOB, TSY, YMG, YPD, 2XYT, LB, M17, or M9 minimal media. Other examples of media that can be used include solutions containing potassium phosphate and/or sodium phosphate. Suitable media can be supplemented with NADH or NADPH.

In one embodiment, the method for producing a fermentation product results in a titer of at least about 20 g/L of a fermentation product. In another embodiment, the method for producing a fermentation product results in a titer of at least about 30 g/L of a fermentation product. In another embodiment, the method for producing a fermentation product results in a titer of at least about 10 g/L, 15 g/L, 20 g/L, 25 g/L, 30 g/L, 35 g/L or 40 g/L of fermentation product.

In embodiments, the rate of production of a fermentation product is increased. In embodiments, the rate of biomass production is increased. In embodiments, the yield of fermentation product is increased. In embodiments, the yield of biomass is increased. Such improvements may be observed by comparison to that obtained using the control recombinant host cell without a genetic switch.

Non-limiting examples of lower alkyl alcohols which may be produced by the methods of the invention include butanol (for example, isobutanol), propanol, isopropanol, and ethanol. In one embodiment, isobutanol is produced.

In one embodiment, the recombinant host cell of the invention produces a fermentation product at a yield of greater than about 25%, 30%, 35%, 40%, 45%, 50%, 55%, 60%, 65%, 70%, or 75% of theoretical. In one embodiment, the recombinant host cell of the invention produces a fermentation product at a yield of greater than about 25% of theoretical. In another embodiment, the recombinant host cell of the invention produces a fermentation product at a yield of greater than about 40% of theoretical. In another embodiment, the recombinant host cell of the invention produces a fermentation product at a yield of greater than about 50% of theoretical. In another embodiment, the recombinant host cell of the invention produces a fermentation product at a yield of greater than about 75% of theoretical.

Non-limiting examples of lower alkyl alcohols produced by the recombinant host cells of the invention include butanol, isobutanol, propanol, isopropanol, and ethanol. In one embodiment, the recombinant host cells of the invention produce isobutanol. In another embodiment, the recombinant host cells of the invention do not produce ethanol.

Methods for Isobutanol Isolation from the Fermentation Medium

Bioproduced butanol may be isolated from the fermentation medium using methods known in the art for ABE fermentations (see, e.g., Durre, *Appl. Microbiol. Biotechnol.* 49:639-648 (1998), Groot et al., *Process. Biochem.* 27:61-75 (1992), and references therein). For example, solids may be removed from the fermentation medium by centrifugation, filtration, decantation, or the like. Then, the butanol may be isolated from the fermentation medium using methods such as distillation, azeotropic distillation, liquid-liquid extraction, adsorption, gas stripping, membrane evaporation, or pervaporation.

Because butanol forms a low boiling point, azeotropic mixture with water, distillation can be used to separate the mixture up to its azeotropic composition. Distillation may be used in combination with another separation method to obtain separation around the azeotrope. Methods that may be used in combination with distillation to isolate and purify butanol include, but are not limited to, decantation, liquid-liquid extraction, adsorption, and membrane-based techniques. Additionally, butanol may be isolated using azeotropic distillation using an entrainer (see, e.g., Doherty and Malone, *Conceptual Design of Distillation Systems*, McGraw Hill, New York, 2001).

The butanol-water mixture forms a heterogeneous azeotrope so that distillation may be used in combination with decantation to isolate and purify the butanol. In this method, the butanol containing fermentation broth is distilled to near the azeotropic composition. Then, the azeotropic mixture is condensed, and the butanol is separated from the fermentation medium by decantation. The decanted aqueous phase may be returned to the first distillation column as reflux. The butanol-rich decanted organic phase may be further purified by distillation in a second distillation column.

The butanol can also be isolated from the fermentation medium using liquid-liquid extraction in combination with distillation. In this method, the butanol is extracted from the fermentation broth using liquid-liquid extraction with a suitable solvent. The butanol-containing organic phase is then distilled to separate the butanol from the solvent.

Distillation in combination with adsorption can also be used to isolate butanol from the fermentation medium. In this method, the fermentation broth containing the butanol is distilled to near the azeotropic composition and then the remaining water is removed by use of an adsorbent, such as molecular sieves (Aden et al., *Lignocellulosic Biomass to Ethanol Process Design and Economics Utilizing Co-Current Dilute Acid Prehydrolysis and Enzymatic Hydrolysis for Corn Stover*, Report NREL/TP-510-32438, National Renewable Energy Laboratory, June 2002).

Additionally, distillation in combination with pervaporation may be used to isolate and purify the butanol from the fermentation medium. In this method, the fermentation broth containing the butanol is distilled to near the azeotropic composition, and then the remaining water is removed by pervaporation through a hydrophilic membrane (Guo et al., *J. Membr. Sci.* 245, 199-210 (2004)).

In situ product removal (ISPR) (also referred to as extractive fermentation) can be used to remove butanol (or other fermentative alcohol) from the fermentation vessel as it is produced, thereby allowing the microorganism to produce butanol at high yields. One method for ISPR for removing fermentative alcohol that has been described in the art is liquid-liquid extraction. In general, with regard to butanol fermentation, for example, the fermentation medium, which includes the microorganism, is contacted with an organic extractant at a time before the butanol concentration reaches a toxic level. The organic extractant and the fermentation medium form a biphasic mixture. The butanol partitions into the organic extractant phase, decreasing the concentration in the aqueous phase containing the microorganism, thereby limiting the exposure of the microorganism to the inhibitory butanol.

Liquid-liquid extraction can be performed, for example, according to the processes described in U.S. Patent Appl. Pub. No. 2009/0305370, the disclosure of which is hereby incorporated in its entirety. U.S. Patent Appl. Pub. No. 2009/0305370 describes methods for producing and recovering butanol from a fermentation broth using liquid-liquid extraction, the methods comprising the step of contacting the fermentation broth with a water immiscible extractant to form a two-phase mixture comprising an aqueous phase and an organic phase. Typically, the extractant can be an organic extractant selected from the group consisting of saturated, mono-unsaturated, poly-unsaturated (and mixtures thereof) $C_{12}$ to $C_{22}$ fatty alcohols, $C_{12}$ to $C_{22}$ fatty acids, esters of $C_{12}$ to $C_{22}$ fatty acids, $C_{12}$ to $C_{22}$ fatty aldehydes, and mixtures thereof. The extractant(s) for ISPR can be non-alcohol extractants. The ISPR extractant can be an exogenous organic extractant such as oleyl alcohol, behenyl alcohol, cetyl alcohol, lauryl alcohol, myristyl alcohol, stearyl alcohol, 1-undecanol, oleic acid, lauric acid, myristic acid, stearic acid, methyl myristate, methyl oleate, undecanal, lauric aldehyde, 20-methylundecanal, and mixtures thereof.

In some embodiments, the alcohol can be formed by contacting the alcohol in a fermentation medium with an organic acid (e.g., fatty acids) and a catalyst capable of esterifying the alcohol with the organic acid. In such embodiments, the organic acid can serve as an ISPR extractant into which the alcohol esters partition. The organic acid can be supplied to the fermentation vessel and/or derived from the biomass supplying fermentable carbon fed to the fermentation vessel. Lipids present in the feedstock can be catalytically hydrolyzed to organic acid, and the same catalyst (e.g., enzymes) can esterify the organic acid with the alcohol. The catalyst can be supplied to the feedstock prior to fermentation, or can be supplied to the fermentation vessel before or contemporaneously with the supplying of the feedstock. When the catalyst is supplied to the fermentation vessel, alcohol esters can be obtained by hydrolysis of the lipids into organic acid and substantially simultaneous esterification of the organic acid with butanol present in the fermentation vessel. Organic acid and/or native oil not derived from the feedstock can also be fed to the fermentation vessel, with the native oil being hydrolyzed into organic acid. Any organic acid not esterified with the alcohol can serve as part of the ISPR extractant. The extractant containing alcohol esters can be separated from the fermentation medium, and the alcohol can be recovered from the extractant. The extractant can be recycled to the fermentation vessel. Thus, in the case of butanol production, for example, the conversion of the butanol to an ester reduces the free butanol concentration in the fermentation medium, shielding the microorganism from the toxic effect of increasing butanol concentration. In addition, unfractionated grain can be used as feedstock without separation of lipids therein, since the lipids can be catalytically hydrolyzed to organic acid, thereby decreasing the rate of build-up of lipids in the ISPR extractant.

In situ product removal can be carried out in a batch mode or a continuous mode. In a continuous mode of in situ product removal, product is continually removed from the reactor. In a batchwise mode of in situ product removal, a volume of organic extractant is added to the fermentation vessel and the extractant is not removed during the process. For in situ product removal, the organic extractant can contact the fermentation medium at the start of the fermentation forming a biphasic fermentation medium. Alternatively, the organic extractant can contact the fermentation medium after the microorganism has achieved a desired amount of growth, which can be determined by measuring the optical density of the culture. Further, the organic extractant can contact the fermentation medium at a time at which the product alcohol level in the fermentation medium reaches a preselected level. In the case of butanol production according to some embodiments of the present invention, the organic acid extractant can contact the fermentation medium at a time before the butanol concentration reaches a toxic level, so as to esterify the butanol with the organic acid to produce butanol esters and consequently reduce the concentration of butanol in the fermentation vessel. The ester-containing organic phase can then be removed from the fermentation vessel (and separated from the fermentation broth which constitutes the aqueous phase) after a desired effective titer of the butanol esters is achieved. In some embodiments, the ester-containing organic phase is separated from the aqueous phase after fermentation of the available fermentable sugar in the fermentation vessel is substantially complete.

Unless defined otherwise, all technical and scientific terms used herein have the same meaning as commonly understood by one of ordinary skill in the art to which this invention belongs. In case of conflict, the present application including the definitions will control. Also, unless otherwise required by context, singular terms shall include pluralities and plural terms shall include the singular. All publications, patents and other references mentioned herein are incorporated by reference in their entireties for all purposes.

EXAMPLES

The present invention is further defined in the following Examples. It should be understood that these Examples, while indicating embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various uses and conditions.

General Methods

Standard recombinant DNA, molecular cloning techniques and transformation protocols used in the Examples are well known in the art and are described by Sambrook et al. (Sambrook, J., Fritsch, E. F. and Maniatis, T. (Molecular Cloning: A Laboratory Manual; Cold Spring Harbor Laboratory Press, Cold Spring Harbor, 1989, here in referred to as Maniatis), by Ausubel et al. (Ausubel et al., Current Protocols in Molecular Biology, pub. by Greene Publishing Assoc. and Wiley-Interscience, 1987) and by Amberg et al (Amberg, D.C., Burke, D. J. and Strathern, J. N. (Methods in Yeast Genetics: A Cold Spring Harbor Laboratory Course Manual, Cold Spring Harbor Press, 2005). Materials and methods suitable for the maintenance and growth of bacterial cultures are well known in the art. Techniques suitable for use in the following examples may be found as set out in Manual of Methods for General Bacteriology (Phillipp et al., eds., American Society for Microbiology, Washington, D.C., 1994) or by Thomas D. Brock in (Brock, Biotechnology: A Textbook of Industrial Microbiology, Second Edition, Sinauer Associates, Inc., Sunderland, Mass. (1989). All reagents, restriction enzymes and materials used for the growth and maintenance of bacterial cells were obtained from Sigma-Aldrich Chemicals (St. Louis, Mo.), BD Diagnostic Systems (Sparks, Md.), Invitrogen (Carlsbad, Calif.), HiMedia (Mumbai, India), SD Fine chemicals (India), or Takara Bio Inc. (Shiga, Japan), unless otherwise specified.

The meaning of abbreviations is as follows: "sec" means second(s), "min" means minute(s), "h" means hour(s), "nm" means nanometers, "uL" means microliter(s), "mL" means milliliter(s), "mg/mL" means milligram per milliliter, "L" means liter(s), "nm" means nanometers, "mM" means millimolar, "M" means molar, "mmol" means millimole(s), "µmole" means micromole(s), "kg" means kilogram, "g" means gram(s), "µg" means microgram(s) and "ng" means nanogram(s), "PCR" means polymerase chain reaction, "OD" means optical density, "OD600" means the optical density measured at a wavelength of 600 nm, "kDa" means kilodaltons, "g" can also mean the gravitation constant, "bp" means base pair(s), "kbp" means kilobase pair(s), "kb" means kilobase, "%" means percent, "% w/v" means weight/volume percent, "% v/v" means volume/volume percent, "HPLC" means high performance liquid chromatography, "g/L" means gram per liter, "µg/L" means microgram per liter, "ng/µL" means nanogram per microliter, "pmol/µL" means picomol per microliter, "RPM" means rotation per minute, "µmol/min/mg" means micromole per minute per milligram, "w/v" means weight per volume, "v/v" means volume per volume.

Example 1

Strain Construction

TABLE 6

Strains referenced in the Examples

| Strain Name | Genotype | Description |
|---|---|---|
| PNY1504 | MATa ura3Δ::loxP his3Δ pdc6Δ pdc1Δ::P[PDC1]-DHAD\|ilvD_Sm-PDC1t pdc5Δ::P[PDC5]-ADH\|sadB_Ax-PDC5t gpd2Δ::loxP and plasmids pYZ090 and pLH468 | US App. Pub. No. 20120237988A1, incorporated herein by reference |
| PNY1556 | MATa ura3Δ::loxP his3Δ pdc6Δ pdc1Δ::P[PDC1]-DHAD\|ilvD_Sm-PDC1t-P[FBA1]-ALS\|alsS_Bs-CYC1t pdc5Δ::P[PDC5]-ADH\|sadB_Ax-PDC5t gpd2Δ::loxP fra2Δ::P[PDC1]-ADH\|adh_Hl-ADH1t adh1Δ::UAS(PGK1)P[FBA1]-kivD_Lg(y)-ADH1t yprcΔ15Δ::P[PDC5]-ADH\|adh_Hl-ADH1t | herein |
| PNY2056 | MATa ura3Δ::loxP his3Δ pdc1Δ::loxP66/71 pdc5Δ::loxP66/71 fra2Δ 2-micron plasmid (CEN.PK2) gpd2Δ::loxP71/66 | herein |
| PNY1558 | MATa ura3Δ::loxP his3Δ pdc1Δ::loxP66/71 pdc5Δ::P[TEF(M4)]-XPK\|xpk1_Lp-CYCt-ADHt-PTA\|eutD_Lp-P[ENO1]-loxP71/66 fra2Δ 2-micron plasmid (CEN.PK2) gpd2Δ::loxP71/66 | herein |
| PNY1559 | PNY1558 with plasmid pHR81-ILV5p-K9JB containing P[ILV5]-KARI\|ilvC_K9JB4P-ILV5t and plasmid pLA84 containing P[FBA1]-DHAD\|ilvD_Sm-FBA1t P[GPM1]-ADH\|adh_Bi(y)-ADH1t P[TDH3]-KivD\|kivD_Lg(y)-TDH3t | herein |
| PNY1560 | PNY1558 pdc1Δ::loxP71/66-P[HXT3]-ALS\|alsS_Bs-PDC1t with plasmid pHR81-ILV5p-K9JB containing P[ILV5]-KARI\|ilvC_K9JB4P-ILV5t and plasmid pLA84 containing P[FBA1]-DHAD\|ilvD_Sm-FBA1t P[GPM1]-ADH\|adh_Bi(y)-ADH1t P[TDH3]-KivD\|kivD_Lg(y)-TDH3t | herein |
| PNY1561 | PNY1558 pdc1Δ::loxP71/66-P[HXT1]-ALS\|alsS_Bs-PDC1t with plasmid pHR81-ILV5p-K9JB containing P[ILV5]-KARI\|ilvC_K9JB4P-ILV5t and plasmid pLA84 containing P[FBA1]-DHAD\|ilvD_Sm-FBA1t P[GPM1]-ADH\|adh_Bi(y)-ADH1t P[TDH3]-KivD\|kivD_Lg(y)-TDH3t | herein |
| PNY1562 | PNY1558 pdc1Δ::loxP71/66-P[PDC1]-ALS\|alsS_Bs-CYC1t with plasmid pHR81-ILV5p-K9JB containing P[ILV5]-KARI\|ilvC_K9JB4P-ILV5t and plasmid pLA84 containing P[FBA1]-DHAD\|ilvD_Sm-FBA1t P[GPM1]-ADH\|adh_Bi(y)-ADH1t P[TDH3]-KivD\|kivD_Lg(y)-TDH3t | herein |
| PNY2289 | PNY1558 pdc1Δ::loxP71/66-P[FBA1::HXT1_331]-ALS\|alsS_Bs-PDC1t with plasmid pHR81-ILV5p-K9JB containing P[ILV5]-KARI\|ilvC_K9JB4P-ILV5t and plasmid pLA84 containing P[FBA1]-DHAD\|ilvD_Sm-FBA1t P[GPM1]-ADH\|adh_Bi(y)-ADH1t P[TDH3]-KivD\|kivD_Lg(y)-TDH3t | herein |

Construction of Strain PNY1556
Construction of PNY1500

The strain BP857 ("PNY1500") was derived from CEN.PK 113-7D (CBS 8340; Centraalbureau voor Schimmelcultures (CBS) Fungal Biodiversity Centre, Netherlands) and contains deletions of the following genes: URA3, HIS3.

URA3 Deletion

To delete the endogenous URA3 coding region, a ura3::loxP-kanMX-loxP cassette was PCR-amplified from pLA54 template DNA (SEQ ID NO: 465). pLA54 contains the K. lactis TEF1 promoter and kanMX marker, and is flanked by loxP sites to allow recombination with Cre recombinase and removal of the marker. PCR was done using Phusion DNA polymerase (New England BioLabs; Ipswich, Mass.) and primers BK505 and BK506 (SEQ ID NOs: 466 and 467). The URA3 portion of each primer was derived from the 5' region upstream of the URA3 promoter and 3' region downstream of the coding region such that integration of the loxP-kanMX-loxP marker resulted in replacement of the URA3 coding region. The PCR product was transformed into CEN.PK 113-7D using standard genetic techniques (Methods in Yeast Genetics, 2005, Cold Spring Harbor Laboratory Press, Cold Spring Harbor, N.Y., pp. 201-202) and transformants were selected on YPD containing G418 (100 µg/ml) at 30° C. Transformants were screened to verify correct integration by PCR using primers LA468 and LA492 (SEQ ID NOs: 468 and 469) and designated CEN.PK 113-7D Δura3::kanMX.

HIS3 Deletion

The four fragments for the PCR cassette for the scarless HIS3 deletion were amplified using Phusion High Fidelity PCR Master Mix (New England BioLabs) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 470) and primer oBP453 (SEQ ID NO: 471), containing a 5' tail with homology to the 5' end of HIS3 Fragment B. HIS3 Fragment B was amplified with primer oBP454 (SEQ ID NO:

472), containing a 5' tail with homology to the 3' end of HIS3 Fragment A, and primer oBP455 (SEQ ID NO: 473), containing a 5' tail with homology to the 5' end of HIS3 Fragment U. HIS3 Fragment U was amplified with primer oBP456 (SEQ ID NO: 474), containing a 5' tail with homology to the 3' end of HIS3 Fragment B, and primer oBP457 (SEQ ID NO: 475), containing a 5' tail with homology to the 5' end of HIS3 Fragment C. HIS3 Fragment C was amplified with primer oBP458 (SEQ ID NO: 474), containing a 5' tail with homology to the 3' end of HIS3 Fragment U, and primer oBP459 (SEQ ID NO: 477). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 470) and oBP455 (SEQ ID NO: 473). HIS3 Fragment UC was created by overlapping PCR by mixing HIS3 Fragment U and HIS3 Fragment C and amplifying with primers oBP456 (SEQ ID NO: 474) and oBP459 (SEQ ID NO: 477). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 470) and oBP459 (SEQ ID NO: 477). The PCR product was purified with a PCR Purification kit (Qiagen).

Competent cells of CEN.PK 113-7D Δura3::kanMX were made and transformed with the HIS3 ABUC PCR cassette using a Frozen-EZ Yeast Transformation II kit (Zymo Research; Orange, Calif.). Transformation mixtures were plated on synthetic complete media lacking uracil supplemented with 2% glucose at 30° C. Transformants with a his3 knockout were screened for by PCR with primers oBP460 (SEQ ID NO: 478) and oBP461 (SEQ ID NO: 479) using genomic DNA prepared with a Gentra Puregene Yeast/Bact kit (Qiagen). A correct transformant was selected as strain CEN.PK 113-7D Δura3::kanMX Δhis3::URA3.

KanMX Marker Removal from the Δura3 Site and URA3 Marker Removal from the Δhis3 Site The KanMX marker was removed by transforming CEN.PK 113-7D Δura3::kanMX Δhis3::URA3 with pRS423::PGAL1-cre (SEQ ID NO: 480) using a Frozen-EZ Yeast Transformation II kit (Zymo Research) and plating on synthetic complete medium lacking histidine and uracil supplemented with 2% glucose at 30° C. Transformants were grown in YP supplemented with 1% galactose at 30° C. for ~6 hours to induce the Cre recombinase and KanMX marker excision and plated onto YPD (2% glucose) plates at 30° C. for recovery. An isolate was grown overnight in YPD and plated on synthetic complete medium containing 5-fluoro-orotic acid (0.1%) at 30° C. to select for isolates that lost the URA3 marker. 5-FOA resistant isolates were grown in and plated on YPD for removal of the pRS423::PGAL1-cre plasmid. Isolates were checked for loss of the KanMX marker, URA3 marker, and pRS423::PGAL1-cre plasmid by assaying growth on YPD+G418 plates, synthetic complete medium lacking uracil plates, and synthetic complete medium lacking histidine plates. A correct isolate that was sensitive to G418 and auxotrophic for uracil and histidine was selected as strain CEN.PK 113-7D Δura3::loxP Δhis3 and designated as BP857. The deletions and marker removal were confirmed by PCR and sequencing with primers oBP450 (SEQ ID NO: 481) and oBP451 (SEQ ID NO: 482) for Δura3 and primers oBP460 (SEQ ID NO: 478) and oBP461 (SEQ ID NO: 479) for Δhis3 using genomic DNA prepared with a Gentra Puregene Yeast/Bact kit (Qiagen).

Construction of Strain PNY2205
PDC6 Deletion

The four fragments for the PCR cassette for the scarless PDC6 deletion were amplified using Phusion High Fidelity PCR Master Mix (New England BioLabs) and CEN.PK 113-7D genomic DNA as template, prepared with a Gentra Puregene Yeast/Bact kit (Qiagen). PDC6 Fragment A was amplified with primer oBP440 (SEQ ID NO: 458) and primer oBP441 (SEQ ID NO: 4599), containing a 5' tail with homology to the 5' end of PDC6 Fragment B. PDC6 Fragment B was amplified with primer oBP442 (SEQ ID NO: 460), containing a 5' tail with homology to the 3" end of PDC6 Fragment A, and primer oBP443 (SEQ ID NO: 461), containing a 5' tail with homology to the 5' end of PDC6 Fragment U. PDC6 Fragment U was amplified with primer oBP444 (SEQ ID NO: 462), containing a 5' tail with homology to the 3' end of PDC6 Fragment B, and primer oBP445 (SEQ ID NO: 463), containing a 5' tail with homology to the 5' end of PDC6 Fragment C. PDC6 Fragment C was amplified with primer oBP446 (SEQ ID NO: 464), containing a 5' tail with homology to the 3' end of PDC6 Fragment U, and primer oBP447 (SEQ ID NO: 483). PCR products were purified with a PCR Purification kit (Qiagen). PDC6 Fragment AB was created by overlapping PCR by mixing PDC6 Fragment A and PDC6 Fragment B and amplifying with primers oBP440 (SEQ ID NO: 458) and oBP443 (SEQ ID NO: 471). PDC6 Fragment UC was created by overlapping PCR by mixing PDC6 Fragment U and PDC6 Fragment C and amplifying with primers oBP444 (SEQ ID NO: 462) and oBP447 (SEQ ID NO: 483). The resulting PCR products were purified on an agarose gel followed by a Gel Extraction kit (Qiagen). The PDC6 ABUC cassette was created by overlapping PCR by mixing PDC6 Fragment AB and PDC6 Fragment UC and amplifying with primers oBP440 (SEQ ID NO: 458) and oBP447 (SEQ ID NO: 483). The PCR product was purified with a PCR Purification kit (Qiagen).

Competent cells of CEN.PK 113-7D Δura3::loxP Δhis3 were made and transformed with the PDC6 ABUC PCR cassette using a Frozen-EZ Yeast Transformation II kit (Zymo Research). Transformation mixtures were plated on synthetic complete media lacking uracil supplemented with 2% glucose at 30° C. Transformants with a pdc6 knockout were screened for by PCR with primers oBP448 (SEQ ID NO: 484) and oBP449 (SEQ ID NO: 485) using genomic DNA prepared with a Gentra Puregene Yeast/Bact kit (Qiagen). A correct transformant was selected as strain CEN.PK 113-7D Δura3::loxP Δhis3 Δpdc6::URA3.

CEN.PK 113-7D Δura3::loxP Δhis3 Δpdc6::URA3 was grown overnight in YPD and plated on synthetic complete medium containing 5-fluoro-orotic acid (0.1%) at 30° C. to select for isolates that lost the URA3 marker. The deletion and marker removal were confirmed by PCR and sequencing with primers oBP448 (SEQ ID NO: 484) and oBP449 (SEQ ID NO: 485) using genomic DNA prepared with a Gentra Puregene Yeast/Bact kit (Qiagen). The absence of the PDC6 gene from the isolate was demonstrated by a negative PCR result using primers specific for the coding sequence of PDC6, oBP554 (SEQ ID NO: 486) and oBP555 (SEQ ID NO: 487). The correct isolate was selected as strain CEN.PK 113-7D Δura3::loxP Δhis3 Δpdc6 and designated as BP891.

PDC1 Deletion ilvDSm Integration

The PDC1 gene was deleted and replaced with the ilvD coding region from Streptococcus mutans ATCC #700610. The A fragment followed by the ilvD coding region from Streptococcus mutans for the PCR cassette for the PDC1 deletion-ilvDSm integration was amplified using Phusion High Fidelity PCR Master Mix (New England BioLabs) and NYLA83 genomic DNA as template, prepared with a Gentra Puregene Yeast/Bact kit (Qiagen). NYLA83 is a strain (construction described in U.S. App. Pub. NO. 20110124060, incorporated herein by reference in its entirety) which carries the PDC1 deletion-ilvDSm integration described in U.S. Patent Application Publication No. 2009/0305363 (herein incorporated by reference in its entirety). PDC1 Fragment A-ilvDSm was amplified with primer oBP513 (SEQ ID NO: 488) and primer oBP515 (SEQ ID NO: 489), containing a 5' tail with homology to the 5' end of PDC1 Fragment B. The B, U, and C fragments for the PCR cassette for the PDC1 deletion-ilvDSm integration were amplified using Phusion High Fidelity PCR Master Mix (New England BioLabs) and CEN.PK 113-7D genomic DNA as template, prepared with a Gentra Puregene Yeast/Bact kit (Qiagen). PDC1 Fragment B was amplified with primer oBP516 (SEQ ID NO: 490) containing a 5' tail with homology to the 3' end of PDC1 Fragment A-ilvDSm, and primer oBP517 (SEQ ID NO: 491), containing a 5' tail with homology to the 5' end of PDC1 Fragment U. PDC1 Fragment U was amplified with primer oBP518 (SEQ ID NO: 492), containing a 5' tail with homology to the 3' end of PDC1 Fragment B, and primer oBP519 (SEQ ID NO: 493), containing a 5' tail with homology to the 5' end of PDC1 Fragment C. PDC1 Fragment C was amplified with primer oBP520 (SEQ ID NO: 494), containing a 5' tail with homology to the 3' end of PDC1 Fragment U, and primer oBP521 (SEQ ID NO: 495). PCR products were purified with a PCR Purification kit (Qiagen). PDC1 Fragment A-ilvDSm-B was created by overlapping PCR by mixing PDC1 Fragment A-ilvDSm (SEQ ID NO: 525) and PDC1 Fragment B and amplifying with primers oBP513 (SEQ ID NO: 488) and oBP517 (SEQ ID NO: 491). PDC1 Fragment UC was created by overlapping PCR by mixing PDC1 Fragment U and PDC1 Fragment C and amplifying with primers oBP518 (SEQ ID NO: 526) and oBP521 (SEQ ID NO: 495). The resulting PCR products were purified on an agarose gel followed by a Gel Extraction kit (Qiagen). The PDC1 A-ilvDSm-BUC cassette (SEQ ID NO: 526) was created by overlapping PCR by mixing PDC1 Fragment A-ilvDSm-B and PDC1 Fragment UC and amplifying with primers oBP513 (SEQ ID NO: 488) and oBP521 (SEQ ID NO: 495). The PCR product was purified with a PCR Purification kit (Qiagen).

Competent cells of CEN.PK 113-7D Δura3::loxP Δhis3 Δpdc6 were made and transformed with the PDC1 A-ilvDSm-BUC PCR cassette using a Frozen-EZ Yeast Transformation II kit (Zymo Research). Transformation mixtures were plated on synthetic complete media lacking uracil supplemented with 2% glucose at 30° C. Transformants with a pdc1 knockout ilvDSm integration were screened for by PCR with primers oBP511 (SEQ ID NO: 496) and oBP512 (SEQ ID NO: 497) using genomic DNA prepared with a Gentra Puregene Yeast/Bact kit (Qiagen). The absence of the PDC1 gene from the isolate was demonstrated by a negative PCR result using primers specific for the coding sequence of PDC1, oBP550 (SEQ ID NO: 498) and oBP551 (SEQ ID NO: 499). A correct transformant was selected as strain CEN.PK 113-7D Δura3::loxP Δhis3 Δpdc6 Δpdc1::ilvDSm-URA3.

CEN.PK 113-7D Δura3::loxP Δhis3 Δpdc6 Δpdc1::ilvDSm-URA3 was grown overnight in YPD and plated on synthetic complete medium containing 5-fluoro-orotic acid (0.1%) at 30° C. to select for isolates that lost the URA3 marker. The deletion of PDC1, integration of ilvDSm, and marker removal were confirmed by PCR and sequencing with primers oBP511 (SEQ ID NO: 496) and oBP512 (SEQ ID NO: 497) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm and designated as BP907.

PDC5 Deletion sadB Integration

The PDC5 gene was deleted and replaced with the sadB coding region from *Achromobacter* xylosoxidans (the sadB gene is described in U.S. Patent Appl. No. 2009/0269823, which is herein incorporated by reference in its entirety). A segment of the PCR cassette for the PDC5 deletion-sadB integration was first cloned into plasmid pUC19-URA3MCS.

pUC19-URA3MCS is pUC19 (SEQ ID NO: 521) based and contains the sequence of the URA3 gene from *S. cerevisiae* situated within a multiple cloning site (MCS). pUC19 contains the pMB1 replicon and a gene coding for beta-lactamase for replication and selection in *E. coli*. In addition to the coding sequence for URA3, the sequences from upstream and downstream of this gene were included for expression of the URA3 gene in yeast. The vector can be used for cloning purposes and can be used as a yeast integration vector.

The DNA encompassing the URA3 coding region along with 250 bp upstream and 150 bp downstream of the URA3 coding region from *Saccharomyces cerevisiae* CEN.PK 113-7D genomic DNA was amplified with primers oBP438 (SEQ ID NO: 516), containing BamHI, AscI, PmeI, and FseI restriction sites, and oBP439 (SEQ ID NO: 517), containing XbaI, PacI, and NotI restriction sites, using Phusion High-Fidelity PCR Master Mix (New England BioLabs). Genomic DNA was prepared using a Gentra Puregene Yeast/Bact kit (Qiagen). The PCR product and pUC19 were ligated with T4 DNA ligase after digestion with BamHI and XbaI to create vector pUC19-URA3MCS. The vector was confirmed by PCR and sequencing with primers oBP264 (SEQ ID NO: 518) and oBP265 (SEQ ID NO: 519).

The coding sequence of sadB and PDC5 Fragment B were cloned into pUC19-URA3MCS to create the sadB-BU portion of the PDC5 A-sadB-BUC PCR cassette. The coding sequence of sadB was amplified using pLH468-sadB (SEQ ID NO: 520) as template with primer oBP530 (SEQ ID NO: 500), containing an AscI restriction site, and primer oBP531 (SEQ ID NO: 501), containing a 5' tail with homology to the 5' end of PDC5 Fragment B. PDC5 Fragment B was amplified with primer oBP532 (SEQ ID NO: 502), containing a 5' tail with homology to the 3' end of sadB, and primer oBP533 (SEQ ID NO: 503), containing a PmeI restriction site. PCR products were purified with a PCR Purification kit (Qiagen). sadB-PDC5 Fragment B was created by overlapping PCR by mixing the sadB and PDC5 Fragment B PCR products and amplifying with primers oBP530 (SEQ ID NO: 500) and oBP533 (SEQ ID NO: 503). The resulting PCR product was digested with AscI and PmeI and ligated with T4 DNA ligase into the corresponding sites of pUC19-URA3MCS after digestion with the appropriate enzymes. The resulting plasmid was used as a template for amplification of sadB-Fragment B-Fragment U using primers oBP536 (SEQ ID NO: 504) and oBP546 (SEQ ID NO: 505), containing a 5' tail with homology to the 5' end of PDC5 Fragment C. PDC5 Fragment C was amplified with primer oBP547 (SEQ ID NO: 506) containing a 5' tail with homology to the 3' end of PDC5 sadB-Fragment B-Fragment U, and primer oBP539 (SEQ ID NO: 507). PCR products were purified with a PCR Purification kit (Qiagen). PDC5 sadB-Fragment B-Fragment U-Fragment C was created by overlapping PCR by mixing PDC5 sadB-Fragment B-Fragment U and PDC5 Fragment C and amplifying with primers oBP536 (SEQ ID NO: 504) and oBP539 (SEQ ID NO: 507). The resulting PCR product was purified on an agarose gel followed by a Gel Extraction kit (Qiagen). The PDC5 A-sadB-BUC cassette (SEQ ID NO: 527) was created by amplifying PDC5 sadB-Fragment B-Fragment U-Fragment C with primers oBP542 (SEQ ID NO: 508), containing a 5' tail with homology to the 50 nucleotides immediately upstream of the native PDC5 coding sequence, and oBP539 (SEQ ID NO: 507). The PCR product was purified with a PCR Purification kit (Qiagen).

Competent cells of CEN.PK 113-7D Δura3::loxP Δhis3 Δpdc6 Δpdc1::ilvDSm were made and transformed with the PDC5 A-sadB-BUC PCR cassette using a Frozen-EZ Yeast Transformation II kit (Zymo Research). Transformation mixtures were plated on synthetic complete media lacking uracil supplemented with 1% ethanol (no glucose) at 30° C. Transformants with a pdc5 knockout sadB integration were screened for by PCR with primers oBP540 (SEQ ID NO: 509) and oBP541 (SEQ ID NO: 510) using genomic DNA prepared with a Gentra Puregene Yeast/Bact kit (Qiagen). The absence of the PDC5 gene from the isolate was demonstrated by a negative PCR result using primers specific for the coding sequence of PDC5, oBP552 (SEQ ID NO: 511) and oBP553 (SEQ ID NO: 512). A correct transformant was selected as strain CEN.PK 113-7D Δura3::loxP Δhis3 Δpdc6 Δpdc1::ilvDSm Δpdc5::sadB-URA3.

CEN.PK 113-7D Δura3::loxP Δhis3 Δpdc6 Δpdc1::ilvDSm Δpdc5::sadB-URA3 was grown overnight in YPE (1% ethanol) and plated on synthetic complete medium supplemented with ethanol (no glucose) and containing 5-fluoro-orotic acid (0.1%) at 30° C. to select for isolates that lost the URA3 marker. The deletion of PDC5, integration of sadB, and marker removal were confirmed by PCR with primers oBP540 (SEQ ID NO: 509) and oBP541 (SEQ ID NO: 510) using genomic DNA prepared with a Gentra Puregene Yeast/Bact kit (Qiagen). The correct isolate was selected as strain CEN.PK 113-7D Δura3::loxP Δhis3 Δpdc6 Δpdc1::ilvDSm Δpdc5::sadB and designated as BP913.

GPD2 Deletion

To delete the endogenous GPD2 coding region, a gpd2::loxP-URA3-loxP cassette (SEQ ID NO: 174) was PCR-amplified using loxP-URA3-loxP PCR as template DNA. loxP-URA3-loxP (SEQ ID NO: 524) contains the URA3 marker from pRS426 flanked by loxP recombinase sites. PCR was done using Phusion DNA polymerase and primers LA512 (SEQ ID NO: 522) and LA513 (SEQ ID NO: 523). The GPD2 portion of each primer was derived from the 5' region upstream of the GPD2 coding region and 3' region downstream of the coding region such that integration of the loxP-URA3-loxP marker resulted in replacement of the GPD2 coding region. The PCR product was transformed into BP913 and transformants were selected on synthetic complete media lacking uracil supplemented with 1% ethanol (no glucose). Transformants were screened to verify correct integration by PCR using primers oBP582 (SEQ ID NO: 513) and AA270 (SEQ ID NO: 514).

The URA3 marker was recycled by transformation with pRS423::PGAL1-cre and plating on synthetic complete media lacking histidine supplemented with 1% ethanol at 30° C. Transformants were streaked on synthetic complete medium supplemented with 1% ethanol and containing 5-fluoro-orotic acid (0.1%) and incubated at 30° C. to select for isolates that had lost the URA3 marker. 5-FOA resistant isolates were grown in YPE (1% ethanol) for removal of the pRS423::PGAL1-cre plasmid. The deletion and marker removal were confirmed by PCR with primers oBP582 (SEQ ID NO: 513) and oBP591 (SEQ ID NO: 515). The correct isolate was selected as strain CEN.PK 113-7D Δura3::loxP Δhis3 Δpdc6 Δpdc1::ilvDSm Δpdc5::sadB Δgpd2::loxP and designated as BP1064 (PNY1503).

FRA2 Deletion

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs) and CEN.PK 113-7D genomic DNA as template, prepared with a Gentra Puregene Yeast/Bact kit (Qiagen). FRA2 Fragment A was amplified with primer oBP594 (SEQ ID NO: 529) and primer oBP595 (SEQ ID NO: 530), containing a 5' tail with homology to the 5' end of FRA2 Fragment B. FRA2 Fragment B was amplified with primer oBP596 (SEQ ID NO: 531), containing a 5' tail with homology to the 3' end of FRA2 Fragment A, and primer oBP597 (SEQ ID NO: 532), containing a 5' tail with homology to the 5' end of FRA2 Fragment U. FRA2 Fragment U was amplified with primer oBP598 (SEQ ID NO: 533), containing a 5' tail with homology to the 3' end of FRA2 Fragment B, and primer oBP599 (SEQ ID NO: 534) containing a 5' tail with homology to the 5' end of FRA2 Fragment C. FRA2 Fragment C was amplified with primer oBP600 (SEQ ID NO: 535), containing a 5' tail with homology to the 3' end of FRA2 Fragment U, and primer oBP601 (SEQ ID NO: 536). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 529) and oBP597 (SEQ ID NO: 532). FRA2 Fragment UC was created by overlapping PCR by mixing FRA2 Fragment U and FRA2 Fragment C and amplifying with primers oBP598 (SEQ ID NO: 533) and oBP601 (SEQ ID NO: 536). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 529) and oBP601 (SEQ ID NO: 536). The PCR product was purified with a PCR Purification kit (Qiagen).

Competent cells of PNY1503 were made and transformed with the FRA2 ABUC PCR cassette using a Frozen-EZ Yeast Transformation II kit (Zymo Research). Transformation mixtures were plated on synthetic complete media lacking uracil supplemented with 1% ethanol at 30° C. Transformants with a fra2 knockout were screened for by PCR with primers oBP602 (SEQ ID NO: 537) and oBP603 (SEQ ID NO: 538) using genomic DNA prepared with a Gentra Puregene Yeast/Bact kit (Qiagen). A correct transformant was grown in YPE (yeast extract, peptone, 1% ethanol) and plated on synthetic complete medium containing 5-fluoro-orotic acid (0.1%) at 30° C. to select for isolates that lost the URA3 marker. The deletion and marker removal were confirmed by PCR with primers oBP602 (SEQ ID NO: 537) and oBP603 (SEQ ID NO: 538) using genomic DNA prepared with a Gentra Puregene Yeast/Bact kit (Qiagen). The absence of the FRA2 gene from the isolate was demonstrated by a negative PCR result using primers specific for the deleted coding sequence of FRA2, oBP605 (SEQ ID NO: 539) and oBP606 (SEQ ID NO: 540). The correct isolate was selected as strain CEN.PK 113-7D MATa ura3Δ::loxP his3Δ pdc6Δ pdc1Δ::P[PDC1]-DHAD|ilvD_Sm-PDC1t pdc5Δ::P[PDC5]-ADH|sadB_Ax-PDC5t gpd2Δ::loxP fra2Δ and designated as PNY1505 (BP1135).

ADH1 Deletion and kivD_Ll(y) Integration

The ADH1 gene was deleted and replaced with the kivD coding region from Lactococcus lactis codon optimized for expression in S. cerevisiae. The scarless cassette for the ADH1 deletion-kivD_Ll(y) integration was first cloned into plasmid pUC19-URA3MCS.

The kivD coding region from *Lactococcus lactis* codon optimized for expression in *S. cerevisiae* was amplified using pLH468 (SEQ ID NO: 553) as template with primer oBP562 (SEQ ID NO: 541), containing a PmeI restriction site, and primer oBP563 (SEQ ID NO: 542), containing a 5' tail with homology to the 5' end of ADH1 Fragment B. ADH1 Fragment B was amplified from genomic DNA prepared as above with primer oBP564 (SEQ ID NO: 543), containing a 5' tail with homology to the 3' end of kivD_Ll(y), and primer oBP565 (SEQ ID NO: 544), containing a FseI restriction site. PCR products were purified with a PCR Purification kit (Qiagen). kivD_Ll(y)-ADH1 Fragment B was created by overlapping PCR by mixing the kivD_Ll(y) and ADH1 Fragment B PCR products and amplifying with primers oBP562 (SEQ ID NO: 541) and oBP565 (SEQ ID NO: 544). The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 545), containing a SacI restriction site, and primer oBP506 (SEQ ID NO: 546), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO: 547), containing a PacI restriction site, and primer oBP508 (SEQ ID NO: 548), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-$P_{FBA1}$ was amplified from vector pRS316-UAS(PGK1)-$P_{FBA1}$-GUS (SEQ ID NO: 554) with primer oBP674 (SEQ ID NO: 549), containing an AscI restriction site, and primer oBP675 (SEQ ID NO: 550), containing a PmeI restriction site. The UAS(PGK1)-$P_{FBA1}$ PCR product was digested with AscI and PmeI and ligated with T4 DNA ligase into the corresponding sites of the plasmid containing kivD_Ll(y)-ADH1 Fragments ABC. The entire integration cassette was amplified from the resulting plasmid with primers oBP505 (SEQ ID NO: 545) and oBP508 (SEQ ID NO: 548) and purified with a PCR Purification kit (Qiagen).

Competent cells of PNY1505 were made and transformed with the ADH1-kivD_Ll(y) PCR cassette constructed above using a Frozen-EZ Yeast Transformation II kit (Zymo Research). Transformation mixtures were plated on synthetic complete media lacking uracil supplemented with 1% ethanol at 30° C. Transformants were grown in YPE (1% ethanol) and plated on synthetic complete medium containing 5-fluoro-orotic acid (0.1%) at 30° C. to select for isolates that lost the URA3 marker. The deletion of ADH1 and integration of kivD_Ll(y) were confirmed by PCR with external primers oBP495 (SEQ ID NO: 551) and oBP496 (SEQ ID NO: 552) and with kivD_Ll(y) specific primer oBP562 (SEQ ID NO: 541) and external primer oBP496 (SEQ ID NO: 552) using genomic DNA prepared with a Gentra Puregene Yeast/Bact kit (Qiagen). The correct isolate was selected as strain CEN.PK 113-7D MATa ura3Δ::loxP his3Δ pdc6Δ pdc1Δ::P[PDC1]-DHAD|ilvD_Sm-PDC1tpdc5Δ::P[PDC5]-ADH|sadB_Ax-PDC5t gpd2Δ::loxP fra2Δ adh1Δ::UAS(PGK1)P[FBA1]-kivD_Ll(y)-ADH1t and designated as PNY1507 (BP1201).

Construction of Strain PNY2211

PNY2211 was constructed in several steps from *S. cerevisiae* strain PNY1507 as described in the following paragraphs. First the strain was modified to contain a phosphoketolase gene. Next, an acetolactate synthase gene (alsS) was added to the strain, using an integration vector targeted to sequence adjacent to the phosphoketolase gene. Finally, homologous recombination was used to remove the phosphoketolase gene and integration vector sequences, resulting in a scarless insertion of alsS in the intergenic region between pdc1Δ::ilvD and the native TRX1 gene of chromosome XII. The resulting genotype of PNY2211 is MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t.

A phosphoketolase gene cassette was introduced into PNY1507 by homologous recombination. The integration construct was generated as follows. The plasmid pRS423::CUP1-alsS+FBA-budA (previously described in US2009/0305363, which is herein incorporated by reference in its entirety) was digested with NotI and XmaI to remove the 1.8 kb FBA-budA sequence, and the vector was religated after treatment with Klenow fragment. Next, the CUP1 promoter was replaced with a TEF1 promoter variant (M4 variant previously described by Nevoigt et al. *Appl. Environ. Microbiol.* 72: 5266-5273 (2006), which is herein incorporated by reference in its entirety) via DNA synthesis and vector construction service from DNA2.0 (Menlo Park, Calif.). The resulting plasmid, pRS423::TEF(M4)-alsS was cut with StuI and MluI (removes 1.6 kb portion containing part of the alsS gene and CYC1 terminator), combined with the 4 kb PCR product generated from pRS426::GPD-xpk1+ADH-eutD (SEQ ID NO: 575) with primers N1176 (SEQ ID NO: 569) and N1177 (SEQ ID NO: 570) and an 0.8 kb PCR product DNA generated from yeast genomic DNA (ENO1 promoter region) with primers N822 (SEQ ID NO: 565) and N1178 (SEQ ID NO: 571) and transformed into *S. cerevisiae* strain BY4741 (ATCC #201388) using gap repair cloning methodology, see Ma et al. *Gene* 58:201-216 (1987). Transformants were obtained by plating cells on synthetic complete medium without histidine. Proper assembly of the expected plasmid (pRS423::TEF1(M4)-xpk1+ENO1-eutD, SEQ ID NO: 561) was confirmed by PCR primers N821 and N1115 (SEQ ID NOs: 564 and 568, respectively) and by restriction digest (BO). Two clones were subsequently sequenced. The 3.1 kb TEF(M4)-xpk1 gene was isolated by digestion with SacI and NotI and cloned into the pUC19-URA3::ilvD-TRX1 vector (Clone A, cut with AflII). Cloning fragments were treated with Klenow fragment to generate blunt ends for ligation. Ligation reactions were transformed into *E. coli* Stbl3 cells, selecting for ampicillin resistance. Insertion of TEF1(M4)-xpk1 was confirmed by PCR (primers N1110 (SEQ ID NO: 558) and N1114 (SEQ ID NO: 567)). The vector was linearized with AflII and treated with Klenow fragment. The 1.8 kb KpnI-HincII geneticin resistance cassette described in WO2011159853A1 (incorporated herein by reference) was cloned by ligation after Klenow fragment treatment. Ligation reactions were transformed into *E. coli* Stbl3 cells, selecting for ampicillin resistance. Insertion of the geneticin cassette was confirmed by PCR (primers N160SeqF5 (SEQ ID NO: 559) and BK468 (SEQ ID NO: 557)). The plasmid sequence is provided herein (pUC19-URA3::pdc1::TEF(M4)-xpk1::kan, SEQ ID NO: 562).

The resulting integration cassette (pdc1::TEF1(M4)-xpk1::KanMX::TRX1) was isolated (AscI and NaeI digestion generated a 5.3 kb band that was gel purified) and transformed into PNY1507 using the Zymo Research Frozen-EZ Yeast Transformation Kit (Cat. No. T2001). Transformants were selected by plating on YPE plus 50 µg/ml G418. Integration at the expected locus was confirmed by PCR (primers N886 and N1214, SEQ ID NOs: 566 and 572, respectively). Next, plasmid pRS423::GAL1p-Cre (SEQ ID NO: 574), encoding Cre recombinase, was used to remove the loxP-flanked KanMX cassette. Proper removal of the cassette was confirmed by PCR (primers oBP512 and N160SeqF5 (SEQ ID NOs: 573 and 559, respectively)). Finally, the alsS integration plasmid (SEQ ID NO: 560; pUC19-kan::pdc1::FBA-alsS::TRX1, clone A) was transformed into this strain using the included geneticin selection marker. Two integrants were tested for acetolactate synthase activity by transformation with plasmids pYZ090ΔalsS (SEQ ID NO: 555) and pBP915 (SEQ ID NO: 556) transformed using Protocol #2 in Amberg, Burke and Strathern "Methods in Yeast Genetics" (2005), and evaluation of growth and isobutanol production in glucose-containing media (methods for growth and isobutanol measurement are as follows: All strains were grown in synthetic complete medium, minus histidine and uracil containing 0.3% glucose and 0.3% ethanol as carbon sources (10 mL medium in 125 mL vented Erlenmeyer flasks (VWR Cat. No. 89095-260). After overnight incubation (30° C., 250 rpm in an Innova®40 New Brunswick Scientific Shaker), cultures were diluted back to 0.2 OD (Eppendorf BioPhotometer measurement) in synthetic complete medium containing 2% glucose and 0.05% ethanol (20 ml medium in 125 mL tightly-capped Erlenmeyer flasks (VWR Cat. No. 89095-260)). After 48 hours incubation (30° C., 250 rpm in an Innova®40 New Brunswick Scientific Shaker), culture supernatants (collected using Spin-X centrifuge tube filter units, Costar Cat. No. 8169) were analyzed by HPLC per methods described in U.S. Appl. Pub. No. 20070092957). One of the two clones was positive and was named PNY2218.

PNY2218 was treated with Cre recombinase, and the resulting clones were screened for loss of the xpk1 gene and pUC19 integration vector sequences by PCR (primers N886 and N160SeqR5; SEQ ID NOs: 566 and 563, respectively). This left only the alsS gene integrated in the pdc1-TRX1 intergenic region after recombination the DNA upstream of xpk1 and the homologous DNA introduced during insertion of the integration vector (a "scarless" insertion since vector, marker gene and loxP sequences are lost). Although this recombination could have occurred at any point, the vector integration appeared to be stable even without geneticin selection, and the recombination event was only observed after introduction of the Cre recombinase. One clone was designated PNY2211.

Construction of PNY1556
Construction of PNY1528 (NADH Integrations in PNY2211)

Deletions/integrations were created by homologous recombination with PCR products containing regions of homology upstream and downstream of the target region and the URA3 gene for selection of transformants. The URA3 gene was removed by homologous recombination to create a scarless deletion/integration.

The scarless deletion/integration procedure was adapted from Akada et al., Yeast, 23:399 (2006). The PCR cassette for each deletion/integration was made by combining four fragments, A-B-U-C, and the gene to be integrated by cloning the individual fragments into a plasmid prior to the entire cassette being amplified by PCR for the deletion/integration procedure. The gene to be integrated was included in the cassette between fragments A and B. The PCR cassette contained a selectable/counter-selectable marker, URA3 (Fragment U), consisting of the native CEN.PK 113-7D URA3 gene, along with the promoter (250 bp upstream of the URA3 gene) and terminator (150 bp downstream of the URA3 gene) regions. Fragments A and C (each approximately 100 to 500 bp long) corresponded to the sequence immediately upstream of the target region (Fragment A) and the 3' sequence of the target region (Fragment C). Fragments A and C were used for integration of the cassette into the chromosome by homologous recombination. Fragment B (500 bp long) corresponded to the 500 bp immediately downstream of the target region and was used for excision of the URA3 marker and Fragment C from the chromosome by homologous recombination, as a direct repeat of the sequence corresponding to Fragment B was created upon integration of the cassette into the chromosome.

YPRCΔ15 Deletion and Horse Liver adh Integration

The YPRCΔ15 locus was deleted and replaced with the horse liver adh gene, codon optimized for expression in *Saccharomyces cerevisiae*, along with the PDC5 promoter region (538 bp) from *Saccharomyces cerevisiae* and the ADH1 terminator region (316 bp) from *Saccharomyces cerevisiae*. The scarless cassette for the YPRCΔ15 deletion-P[PDC5]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). YPRCΔ15 Fragment A was amplified from genomic DNA with primer oBP622 (SEQ ID NO: 745), containing a KpnI restriction site, and primer oBP623 (SEQ ID NO: 746), containing a 5' tail with homology to the 5' end of YPRCΔ15 Fragment B. YPRCΔ15 Fragment B was amplified from genomic DNA with primer oBP624 (SEQ ID NO: 747), containing a 5' tail with homology to the 3' end of YPRCΔ15 Fragment A, and primer oBP625 (SEQ ID NO: 748), containing a FseI restriction site. PCR products were purified with a PCR Purification kit (Qiagen). YPRCΔ15 Fragment A-YPRCΔ15 Fragment B was created by overlapping PCR by mixing the YPRCΔ15 Fragment A and YPRCΔ15 Fragment B PCR products and amplifying with primers oBP622 (SEQ ID NO: 745) and oBP625 (SEQ ID NO: 748). The resulting PCR product was digested with KpnI and FseI and ligated with T4 DNA ligase into the corresponding sites of pUC19-URA3MCS after digestion with the appropriate enzymes. YPRCΔ15 Fragment C was amplified from genomic DNA with primer oBP626 (SEQ ID NO: 749), containing a NotI restriction site, and primer oBP627 (SEQ ID NO: 191), containing a PacI restriction site. The YPRCΔ15 Fragment C PCR product was digested with NotI and PacI and ligated with T4 DNA ligase into the corresponding sites of the plasmid containing YPRCΔ15 Fragments AB. The PDC5 promoter region was amplified from CEN.PK 113-7D genomic DNA with primer HY21 (SEQ ID NO: 751), containing an AscI restriction site, and primer HY24 (SEQ ID NO: 752), containing a 5' tail with homology to the 5' end of adh_Hl(y). adh_Hl(y)-ADH1t was amplified from pBP915 (SEQ ID NO: 556) with primers HY25 (SEQ ID NO: 753), containing a 5' tail with homology to the 3' end of P[PDC5], and HY4 (SEQ ID NO: 754), containing a PmeI restriction site. PCR products were purified with a PCR Purification kit (Qiagen). P[PDC5]-adh_HL(y)-ADH1t was created by overlapping PCR by mixing the P[PDC5] and adh_HL(y)-ADH1t PCR products and amplifying with primers HY21 (SEQ ID NO: 751) and HY4 (SEQ ID NO: 754).The resulting PCR product was digested with AscI and PmeI and ligated with T4 DNA ligase into the corresponding sites of the plasmid containing YPRCΔ15 Fragments ABC. The entire integration cassette was amplified from the resulting plasmid with primers oBP622 (SEQ ID NO: 745) and oBP627 (SEQ ID NO: 750).

Competent cells of PNY2211 were made and transformed with the YPRCΔ15 deletion-P[PDC5]-adh_HL(y)-ADH1t integration cassette PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were screened for by PCR with primers URA3-end F (SEQ ID NO: 755) and oBP637 (SEQ ID NO: 756). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of YPRCΔ15 and integration of P[PDC5]-adh_HL(y)-ADH1t were confirmed by PCR with external primers oBP636 (SEQ ID NO: 757) and oBP637 (SEQ ID NO: 756) using genomic DNA prepared with a YeaStar Genomic DNA kit (Zymo Research). A correct isolate of the following genotype was selected for further modification: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ adh1Δ::UAS(PGK1)P[FBA1]-kivD_Ll(y)-ADH1t yprcΔ15Δ::P[PDC5]-ADH|adh_H1-ADH1t.

Horse Liver adh Integration at fra2Δ

The horse liver adh gene, codon optimized for expression in *Saccharomyces cerevisiae*, along with the PDC1 promoter region (870 bp) from *Saccharomyces cerevisiae* and the ADH1 terminator region (316 bp) from *Saccharomyces cerevisiae*, was integrated into the site of the fra2 deletion. The scarless cassette for the fra2Δ-P[PDC1]-adh_HL(y)-ADH1t integration was first cloned into plasmid pUC19-URA3MCS.

Fragments A-B-U-C were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). fra2Δ Fragment C was amplified from genomic DNA with primer oBP695 (SEQ ID NO: 758), containing a NotI restriction site, and primer oBP696 (SEQ ID NO: 744), containing a PacI restriction site. The fra2Δ Fragment C PCR product was digested with NotI and PacI and ligated with T4 DNA ligase into the corresponding sites of pUC19-URA3MCS. fra2Δ Fragment B was amplified from genomic DNA with primer oBP693 (SEQ ID NO: 760), containing a PmeI restriction site, and primer oBP694 (SEQ ID NO: 761), containing a FseI restriction site. The resulting PCR product was digested with PmeI and FseI and ligated with T4 DNA ligase into the corresponding sites of the plasmid containing fra2Δ fragment C after digestion with the appropriate enzymes. fra2Δ Fragment A was amplified from genomic DNA with primer oBP691 (SEQ ID NO: 743), containing BamHI and AsiSI restriction sites, and primer oBP692 (SEQ ID NO: 763), containing AscI and SwaI restriction sites. The fra2Δ fragment A PCR product was digested with BamHI and AscI and ligated with T4 DNA ligase into the corresponding sites of the plasmid containing fra2Δ fragments BC after digestion with the appropriate enzymes. The PDC1 promoter region was amplified from CEN.PK 113-7D genomic DNA with primer HY16 (SEQ ID NO: 766), containing an AscI restriction site, and primer HY19 (SEQ ID NO: 767), containing a 5' tail with homology to the 5' end of adh_Hl(y). adh_Hl(y)-ADH1t was amplified from pBP915 with primers HY20 (SEQ ID NO: 762), containing a 5' tail with homology to the 3' end of P[PDC1], and HY4 (SEQ ID NO: 754), containing a PmeI restriction site. PCR products were purified with a PCR Purification kit (Qiagen). P[PDC1]-adh_HL(y)-ADH1t was created by overlapping PCR by mixing the P[PDC1] and adh_HL(y)-ADH1t PCR products and amplifying with primers HY16 (SEQ ID NO: 766) and HY4 (SEQ ID NO: 754). The resulting PCR product was digested with AscI and PmeI and ligated with T4 DNA ligase into the corresponding sites of the plasmid containing fra2Δ Fragments ABC. The entire integration cassette was amplified from the resulting plasmid with primers oBP691 (SEQ ID NO: 743) and oBP696 (SEQ ID NO: 744).

Competent cells of the PNY2211 variant with adh_Hl(y) integrated at YPRCΔ15 were made and transformed with the fra2Δ-P[PDC1]-adh_HL(y)-ADH1t integration cassette PCR product using a Frozen-EZ Yeast Transformation II kit (Zymo Research). Transformation mixtures were plated on synthetic complete media lacking uracil supplemented with 1% ethanol at 30 C. Transformants were screened for by PCR with primers URA3-end F (SEQ ID NO: 755) and oBP731 (SEQ ID NO: 765). Correct transformants were grown in YPE (1% ethanol) and plated on synthetic complete medium supplemented with 1% EtOH and containing 5-fluoro-orotic acid (0.1%) at 30 C to select for isolates that lost the URA3 marker. The integration of P[PDC1]-adh_HL(y)-ADH1t was confirmed by colony PCR with internal primer HY31 (SEQ ID NO: 759) and external primer oBP731 (SEQ ID NO: 765) and PCR with external primers oBP730 (SEQ ID NO: 764) and oBP731 (SEQ ID NO: 765) using genomic DNA prepared with a YeaStar Genomic DNA kit (Zymo Research). A correct isolate of the following genotype was designated PNY1528: CEN.PK 113-7D MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_H1-ADH1t adh1Δ::UAS(PGK1)P[FBA1]-kivD_Ll(y)-ADH1t yprcΔ15Δ::P[PDC5]-ADH|adh_H1-ADH1t.

Construction of PNY1556 from PNY1528

The following describes the assembly of the constructs used to replace the chromosomal copy of kivD_Ll(y) in PNY1528 at the adh1Δ locus with kivD_Lg(y) or kivD_Mc(y) and construction of strain PNY1556 expressing the kivD genes.

Deletions/integrations were created by homologous recombination with PCR products containing regions of homology upstream and downstream of the target region and the URA3 gene for selection of transformants as described in the previous section.

The plasmid to integrate kivD_Lg(y) was derived from a plasmid constructed to integrate UAS(PGK1)P[FBA1]-kivD_Ll(y) into the ADH1 locus of *Saccaromyces cerevisiae*. Construction of the plasmid used to integrate UAS(PGK1)P[FBA1]-kivD_Ll(y) into the ADH1 locus is described below. The plasmids were constructed in pUC19-URA3MCS.

Construction of the ADH1 Deletion/UAS(PGK1)P[FBA1]-kivD_Ll(y) Integration Plasmid The kivD coding region from *Lactococcus lactis* codon optimized for expression in *Saccharomyces cerevisiae*, kivD_Ll(y), was amplified using pLH468 (SEQ ID NO: 553) as template with primer oBP562 (SEQ ID NO: 541), containing a PmeI restriction site, and primer oBP563 (SEQ ID NO: 114), containing a 5' tail with homology to the 5' end of ADH1 Fragment B. ADH1 Fragment B was amplified from *Saccharomyces cerevisiae* CEN.PK 113-7D genomic DNA with primer oBP564 (SEQ ID NO: 543), containing a 5' tail with homology to the 3' end of kivD_Ll(y), and primer oBP565 (SEQ ID NO: 544), containing a FseI restriction site. PCR products were purified with a PCR Purification kit (Qiagen; Valencia, Calif.). kivD_Ll(y)-ADH1 Fragment B was created by overlapping PCR by mixing the kivD_Ll(y) and ADH1 Fragment B PCR products and amplifying with primers oBP562 (SEQ ID NO: 541) and oBP565 (SEQ ID NO: 544).

The resulting PCR product was digested with PmeI and FseI and ligated with T4 DNA ligase into the corresponding sites of pUC19-URA3MCS after digestion with the appropriate enzymes. ADH1 Fragment A was amplified from genomic DNA with primer oBP505 (SEQ ID NO: 545), containing a SacI restriction site, and primer oBP506 (SEQ ID NO: 546), containing an AscI restriction site. The ADH1 Fragment A PCR product was digested with SacI and AscI and ligated with T4 DNA ligase into the corresponding sites of the plasmid containing kivD_Ll(y)-ADH1 Fragment B. ADH1 Fragment C was amplified from genomic DNA with primer oBP507 (SEQ ID NO: 547), containing a PacI restriction site, and primer oBP508 (SEQ ID NO: 548), containing a SalI restriction site. The ADH1 Fragment C PCR product was digested with PacI and SalI and ligated with T4 DNA ligase into the corresponding sites of the plasmid containing ADH1 Fragment A-kivD_Ll(y)-ADH1 Fragment B. The hybrid promoter UAS(PGK1)-P$_{FBA1}$ was amplified from vector pRS316-UAS(PGK1)-P$_{FBA1}$-GUS (SEQ ID NO: 554) with primer oBP674 (SEQ ID NO: 549), containing an AscI restriction site, and primer oBP675 (SEQ ID NO: 550), containing a PmeI restriction site. The UAS(PGK1)-P$_{FBA1}$ PCR product was digested with AscI and PmeI and ligated with T4 DNA ligase into the corresponding sites of the plasmid containing kivD_Ll(y)-ADH1 Fragments ABC to generate pBP1181.

kivD_Ll(y) was removed from the ADH1 deletion/UAS (PGK1)P[FBA1]-kivD_Ll(y) integration plasmid pBP1181. The plasmid was digested with PmeI and FseI and the large DNA fragment was purified on an agarose gel followed by a gel extraction kit (Qiagen). ADH1 fragment B was amplified from pBP1181 with primer oBP821 (SEQ ID NO: 564), containing a PmeI restriction site, and primer oBP484 (SEQ ID NO: 578), containing a FseI restriction site. The ADH1 fragment B PCR product was digested with PmeI and FseI and ligated with T4 DNA ligase into the corresponding sites of the gel purified large DNA fragment. A PCR fragment corresponding to the 3' 500 bp of kivD_Ll(y) was cloned into the resulting vector for the targeted deletion of kivD_Ll(y) in PNY1528. The fragment was amplified from pBP1181 with primers oBP822 (SEQ ID NO: 579), containing a NotI restriction site, and oBP823 (SEQ ID NO: 580), containing a PacI restriction site. The fragment was digested with NotI and PacI and ligated with T4 DNA ligase into the corresponding sites downstream of URA3 in the above plasmid with the kivD_Ll(y) deletion after digestion with the appropriate restriction enzymes. The resulting plasmid was designated pBP1716.

The kivD coding region from Listeria grayi codon optimized for expression in Saccharomyces cerevisiae (SEQ ID NO: 581), kivD_Lg(y), was synthesized by DNA2.0 (Menlo Park, Calif.). kivD_Lg(y) was amplified with primers oBP828 (SEQ ID NO: 582), containing a PmeI restriction site, and oBP829 (SEQ ID NO: 583) containing a PmeI restriction site. The resulting PCR product was digested with PmeI and ligated with T4 DNA ligase into the corresponding site in pBP1716 after digestion with the appropriate enzyme. The orientation of the cloned gene was checked by PCR with primers FBAp-F (SEQ ID NO: 576) and oBP829 (SEQ ID NO: 583). An isolate with kivD_Lg(y) in the correct orientation was designated pBP1719.

The kivD_Ll(y) deletion/kivD_Lg(y) integration cassette was amplified from pBP1719 with primers oBP505 (SEQ ID NO: 545) and oBP823 (SEQ ID NO: 580). Competent cells of the PNY1528 were made and transformed with the PCR product using a Frozen-EZ Yeast Transformation II kit (Zymo Research; Orange, Calif.). Transformation mixtures were plated on synthetic complete media lacking uracil supplemented with 1% ethanol at 30 C. Transformants were grown in YPE (1% ethanol) and plated on synthetic complete medium supplemented with 1% EtOH and containing 5-fluoro-orotic acid (0.1%) at 30 C to select for isolates that lost the URA3 marker. The deletion of kivD_Ll(y) and integration of kivD_Lg(y) was confirmed by PCR with primers oBP674 (SEQ ID NO: 549) and oBP830 (SEQ ID NO: 584) using genomic DNA prepared with a YeaStar Genomic DNA kit (Zymo Research). A correct isolate contained kivD_Lg(y) at the same locus and expressed from the same promoter as kivD_Ll(y) in PNY1528 and was designated PNY1556.

Construction of Strain PNY2056

Saccharomyces cerevisiae strain PNY0827 is used as the host cell for further genetic manipulation to construct PNY2056. PNY0827 refers to a strain derived from Saccharomyces cerevisiae which has been deposited at the ATCC under the Budapest Treaty on Sep. 22, 2011 at the American Type Culture Collection, Patent Depository 10801 University Boulevard, Manassas, Va. 20110-2209 and has the patent deposit designation PTA-12105.

Deletion of URA3 and Sporulation into Haploids

In order to delete the endogenous URA3 coding region, a deletion cassette was PCR-amplified from pLA54 (SEQ ID NO: 465) which contains a P$_{TEF1}$-kanMX4-TEF1t cassette flanked by loxP sites to allow homologous recombination in vivo and subsequent removal of the KANMX4 marker. PCR was done by using Phusion High Fidelity PCR Master Mix (New England BioLabs; Ipswich, Mass.) and primers BK505 (SEQ ID NO: 466) and BK506 (SEQ ID NO: 467). The URA3 portion of each primer was derived from the 5' region 180 bp upstream of the URA3 ATG and 3' region 78 bp downstream of the coding region such that integration of the kanMX4 cassette results in replacement of the URA3 coding region. The PCR product was transformed into PNY0827 using standard genetic techniques (Methods in Yeast Genetics, 2005, Cold Spring Harbor Laboratory Press, Cold Spring Harbor, N.Y., pp. 201-202) and transformants were selected on YEP medium supplemented 2% glucose and 100 μg/ml Geneticin at 30° C. Transformants were screened by colony PCR with primers LA468 (SEQ ID NO: 468) and LA492 (SEQ ID NO: 469) to verify presence of the integration cassette. A heterozygous diploid was obtained: NYLA98, which has the genotype MATa/a URA3/ura3::loxP-kanMX4-loxP. To obtain haploids, NYLA98 was sporulated using standard methods (Codón A C, Gasent-Ramírez J M, Benítez T. Factors which affect the frequency of sporulation and tetrad formation in Saccharomyces cerevisiae baker's yeast. Appl Environ Microbiol. 1995 PMID: 7574601). Tetrads were dissected using a micromanipulator and grown on rich YPE medium supplemented with 2% glucose. Tetrads containing four viable spores were patched onto synthetic complete medium lacking uracil supplemented with 2% glucose, and the mating type was verified by multiplex colony PCR using primers AK109-1 (SEQ ID NO: 585), AK109-2 (SEQ ID NO: 586), and AK109-3 (SEQ ID NO: 587). The resulting indentified haploid strain called NYLA103, which has the genotype: MATα ura3Δ::loxP-kanMX4-loxP, and NYLA106, which has the genotype: MATa ura3Δ::loxP-kanMX4-loxP.

Deletion of His3

To delete the endogenous HIS3 coding region, a scarless deletion cassette was used. The four fragments for the PCR cassette for the scarless HIS3 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). HIS3 Fragment A was amplified with primer oBP452 (SEQ ID NO: 470) and primer oBP453 (SEQ ID NO: 471), containing a 5' tail with homology to the 5' end of HIS3 Fragment B. HIS3 Fragment B was amplified with primer oBP454 (SEQ ID NO: 472), containing a 5' tail with homology to the 3' end of HIS3 Fragment A, and primer oBP455 (SEQ ID NO: 473) containing a 5' tail with homology to the 5' end of HIS3 Fragment U. HIS3 Fragment U was amplified with primer oBP456 (SEQ ID NO: 474), containing a 5' tail with homology to the 3' end of HIS3 Fragment B, and primer oBP457 (SEQ ID NO: 475), containing a 5' tail with homology to the 5' end of HIS3 Fragment C. HIS3 Fragment C was amplified with primer oBP458 (SEQ ID NO: 476), containing a 5' tail with homology to the 3' end of HIS3 Fragment U, and primer oBP459 (SEQ ID NO: 477). PCR products were purified with a PCR Purification kit (Qiagen). HIS3 Fragment AB was created by overlapping PCR by mixing HIS3 Fragment A and HIS3 Fragment B and amplifying with primers oBP452 (SEQ ID NO: 470) and oBP455 (SEQ ID NO: 473). HIS3 Fragment UC was created by overlapping PCR by mixing HIS3 Fragment U and HIS3 Fragment C and amplifying with primers oBP456 (SEQ ID NO: 474) and oBP459 (SEQ ID NO: 477). The resulting PCR products were purified on an agarose gel followed by a Gel Extraction kit (Qiagen). The HIS3 ABUC cassette was created by overlapping PCR by mixing HIS3 Fragment AB and HIS3 Fragment UC and amplifying with primers oBP452 (SEQ ID NO: 470) and oBP459 (SEQ ID NO: 477). The PCR product was purified with a PCR Purification kit (Qiagen). Competent cells of NYLA106 were transformed with the HIS3 ABUC PCR cassette and were plated on synthetic complete medium lacking uracil supplemented with 2% glucose at 30° C. Transformants were screened to verify correct integration by replica plating onto synthetic complete medium lacking histidine and supplemented with 2% glucose at 30° C. Genomic DNA preps were made to verify the integration by PCR using primers oBP460 (SEQ ID NO: 478) and LA135 (SEQ ID NO: 590) for the 5' end and primers oBP461 (SEQ ID NO: 479) and LA92 (SEQ ID NO: 590) for the 3' end. The URA3 marker was recycled by plating on synthetic complete medium supplemented with 2% glucose and 5-FOA at 30° C. following standard protocols. Marker removal was confirmed by patching colonies from the 5-FOA plates onto SD-URA medium to verify the absence of growth. The resulting identified strain, called PNY2003 has the genotype: MATa ura3Δ::loxP-kanMX4-loxP his3Δ.

Deletion of PDC1

To delete the endogenous PDC1 coding region, a deletion cassette was PCR-amplified from pLA59 (SEQ ID NO: 591), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA678 (SEQ ID NO: 592) and LA679 (SEQ ID NO: 593). The PDC1 portion of each primer was derived from the 5' region 50 bp downstream of the PDC1 start codon and 3' region 50 bp upstream of the stop codon such that integration of the URA3 cassette results in replacement of the PDC1 coding region but leaves the first 50 bp and the last 50 bp of the coding region. The PCR product was transformed into PNY2003 using standard genetic techniques and transformants were selected on synthetic complete medium lacking uracil and supplemented with 2% glucose at 30° C. Transformants were screened to verify correct integration by colony PCR using primers LA337 (SEQ ID NO: 597), external to the 5' coding region and LA135 (SEQ ID NO: 588), an internal primer to URA3. Positive transformants were then screened by colony PCR using primers LA692 (SEQ ID NO: 595) and LA693 (SEQ ID NO: 596), internal to the PDC1 coding region. The URA3 marker was recycled by transforming with pLA34 (SEQ ID NO: 597) containing the CRE recombinase under the GAL1 promoter and plated on synthetic complete medium lacking histidine and supplemented with 2% glucose at 30° C. Transformants were plated on rich medium supplemented with 0.5% galactose to induce the recombinase. Marker removal was confirmed by patching colonies to synthetic complete medium lacking uracil and supplemented with 2% glucose to verify absence of growth. The resulting identified strain, called PNY2008 has the genotype: MATa ura3Δ::loxP-kanMX4-loxP his3Δpdc1Δ::loxP71/66.

Deletion of PDC5

To delete the endogenous PDC5 coding region, a deletion cassette was PCR-amplified from pLA59 (SEQ ID NO: 591), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA722 (SEQ ID NO: 598) and LA733 (SEQ ID NO: 599). The PDC5 portion of each primer was derived from the 5' region 50 bp upstream of the PDC5 start codon and 3' region 50 bp downstream of the stop codon such that integration of the URA3 cassette results in replacement of the entire PDC5 coding region. The PCR product was transformed into PNY2008 using standard genetic techniques and transformants were selected on synthetic complete medium lacking uracil and supplemented with 1% ethanol at 30° C. Transformants were screened to verify correct integration by colony PCR using primers LA453 (SEQ ID NO: 600), external to the 5' coding region and LA135 (SEQ ID NO: 588), an internal primer to URA3. Positive transformants were then screened by colony PCR using primers LA694 (SEQ ID NO: 601) and LA695 (SEQ ID NO: 602), internal to the PDC5 coding region. The URA3 marker was recycled by transforming with pLA34 (SEQ ID NO: 597) containing the CRE recombinase under the GAL1 promoter and plated on synthetic complete medium lacking histidine and supplemented with 1% ethanol at 30° C. Transformants were plated on rich YEP medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2009 has the genotype: MATa ura3Δ::loxP-kanMX4-loxP his3Δ pdc1 Δ::loxP71/66 pdc5Δ::loxP71/66.

Deletion of FRA2

The FRA2 deletion was designed to delete 250 nucleotides from the 3' end of the coding sequence, leaving the first 113 nucleotides of the FRA2 coding sequence intact. An in-frame stop codon was present 7 nucleotides downstream of the deletion. The four fragments for the PCR cassette for the scarless FRA2 deletion were amplified using Phusion High Fidelity PCR Master Mix (New England BioLabs; Ipswich, Mass.) and CEN.PK 113-7D genomic DNA as template, prepared with a Gentra Puregene Yeast/Bact kit (Qiagen; Valencia, Calif.). FRA2 Fragment A was amplified with primer oBP594 (SEQ ID NO: 529) and primer oBP595 (SEQ ID NO: 530), containing a 5' tail with homology to the 5' end of FRA2 Fragment B. FRA2 Fragment B was amplified with primer oBP596 (SEQ ID NO: 531), containing a 5" tail with homology to the 3' end of FRA2 Fragment A, and primer oBP597 (SEQ ID NO: 532), containing a 5' tail with homology to the 5' end of FRA2 Fragment U. FRA2 Fragment U was amplified with primer oBP598 (SEQ ID NO: 533), containing a 5' tail with homology to the 3' end of FRA2 Fragment B, and primer oBP599 (SEQ ID NO: 534), containing a 5' tail with homology to the 5' end of FRA2 Fragment C. FRA2 Fragment C was amplified with primer oBP600 (SEQ ID NO: 535), containing a 5' tail with homology to the 3' end of FRA2 Fragment U, and primer oBP601 (SEQ ID NO: 536). PCR products were purified with a PCR Purification kit (Qiagen). FRA2 Fragment AB was created by overlapping PCR by mixing FRA2 Fragment A and FRA2 Fragment B and amplifying with primers oBP594 (SEQ ID NO: 529) and oBP597 (SEQ ID NO: 532). FRA2 Fragment UC was created by overlapping PCR by mixing FRA2 Fragment U and FRA2 Fragment C and amplifying with primers oBP598 (SEQ ID NO: 533) and oBP601 (SEQ ID NO: 536). The resulting PCR products were purified on an agarose gel followed by a Gel Extraction kit (Qiagen). The FRA2 ABUC cassette was created by overlapping PCR by mixing FRA2 Fragment AB and FRA2 Fragment UC and amplifying with primers oBP594 (SEQ ID NO: 529) and oBP601 (SEQ ID NO: 536). The PCR product was purified with a PCR Purification kit (Qiagen).

To delete the endogenous FRA2 coding region, the scarless deletion cassette obtained above was transformed into PNY2009 using standard techniques and plated on synthetic complete medium lacking uracil and supplemented with 1% ethanol. Genomic DNA preps were made to verify the integration by PCR using primers oBP602 (SEQ ID NO: 537) and LA135 (SEQ ID NO: 588) for the 5' end, and primers oBP602 (SEQ ID NO: 537) and oBP603 (SEQ ID NO: 538) to amplify the whole locus. The URA3 marker was recycled by plating on synthetic complete medium supplemented with 1% ethanol and 5-FOA (5-Fluoroorotic Acid) at 30° C. following standard protocols. Marker removal was confirmed by patching colonies from the 5-FOA plates onto synthetic complete medium lacking uracil and supplemented with 1% ethanol to verify the absence of growth. The resulting identified strain, PNY2037, has the genotype: MATa ura3Δ::loxP-kanMX4-loxP his3Δ pdc1Δ::loxP71/66 pdc5Δ::loxP71/66 fra2Δ.

Addition of Native 2 Micron Plasmid

The loxP71-URA3-loxP66 marker was PCR-amplified using Phusion DNA polymerase (New England BioLabs; Ipswich, Mass.) from pLA59 (SEQ ID NO: 591), and transformed along with the LA811x817 (SEQ ID NOs: 603, 604) and LA812x818 (SEQ ID NOs: 605,606) 2-micron plasmid fragments (amplified from the native 2-micron plasmid from CEN.PK 113-7D; Centraalbureau voor Schimmelcultures (CBS) Fungal Biodiversity Centre) into strain PNY2037 on SE-URA plates at 30° C. The resulting strain PNY2037 2μ:: loxP71-URA3-loxP66 was transformed with pLA34 (pRS423::cre) (also called, pLA34) (SEQ ID NO: 597) and selected on SE-HIS-URA plates at 30° C. Transformants were patched onto YP-1% galactose plates and allowed to grow for 48 hrs at 30° C. to induce Cre recombinase expression. Individual colonies were then patched onto SE-URA, SE-HIS, and YPE plates to confirm URA3 marker removal. The resulting identified strain, PNY2050, has the genotype: MATa ura3Δ::loxP-kanMX4-loxP, his3Δ pdc1Δ::loxP71/66 pdc5Δ::loxP71/66 fra2Δ 2-micron.

Construction of PNY2068 from PNY2050

PNY2068 [MATa ura3Δ::loxP-kanMX4-loxP his3Δ pdc1Δ::loxP71/66 pdc5Δ::loxP71/66 fra2Δ 2-micron gpd2Δ ymr226cΔ::P$_{FBA1}$-alsS_Bs-CYC1t-loxP71/66 ald6Δ::(UAS) PGK1-P$_{FBA1}$-kivD_Lg-TDH3t-loxP71/66 adh1Δ::P$_{ILV5}$-ADH_Bi(y)-ADH1t-loxP71/66 pdc1Δ::P$_{PDC1}$-ADH_Bi(y)-ADH1t-loxP71/66] was constructed as follows from PNY2050.

Deletion of GPD2

To delete the endogenous GPD2 coding region, a deletion cassette was PCR-amplified from pLA59 (SEQ ID NO: 591), which contains a URA3 marker flanked by degenerate loxP sites to allow homologous recombination in vivo and subsequent removal of the URA3 marker. PCR was done by using Phusion High Fidelity PCR Master Mix (New England BioLabs; Ipswich, Mass.) and primers LA512 (SEQ ID NO: 522) and LA513 (SEQ ID NO: 523). The GPD2 portion of each primer was derived from the 5' region 50 bp upstream of the GPD2 start codon and 3' region 50 bp downstream of the stop codon such that integration of the URA3 cassette results in replacement of the entire GPD2 coding region. The PCR product was transformed into PNY2050 using standard genetic techniques and transformants were selected on synthetic complete medium lacking uracil and supplemented with 1% ethanol at 30° C. Transformants were screened to verify correct integration by colony PCR using primers LA516 (SEQ ID NO: 607), external to the 5' coding region and LA135 (SEQ ID NO: 588), internal to URA3. Positive transformants were then screened by colony PCR using primers LA514 (SEQ ID NO: 608) and LA515 (SEQ ID NO: 609), internal to the GPD2 coding region. The URA3 marker was recycled by transforming with pLA34 (SEQ ID NO: 597) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, PNY2056, has the genotype: MATa ura3Δ::loxP-kanMX4-loxP his3Δ pdc1Δ::loxP71/66 pdc5Δ::loxP71/66 fra2Δ 2-micron gpd2Δ.

Construction of Strain PNY1558

PNY1558 was derived from PNY2056 by integrating a phosphoketolase and phosphotransacetylase expression cassette at the pdc5Δ::loxP locus in PNY2056 to create a C2-independent strain. The phosphoketolase and phosphotransacetylase expression cassette, P[TEF(M4)]-xpk1+P[ENO1]-eutD (SEQ ID 610), was from pRS423::TEF(M4)-xpk1+ENO1-eutD (SEQ ID NO: 561; US20120237988, incorporated herein by reference), which has the xpk1 gene from *Lactobacillus plantarum* expressed from the yeast TEF1 mutant 4 promoter (Nevoigt et al. 2006. Applied and Environmental Microbiology, v72 p5266) and followed by the CYC1 terminator for expression of phosphoketolase and the eutD gene from *Lactobacillus plantarum* expressed from the yeast ENOL promoter and followed by the ADH1 terminator for expression of phosphotransacetylase. The phosphoketolase and phosphotransacetylase expression cassette was amplified from pRS423::TEF(M4)-xpk1+ENO1-eutD using primers oBP962 (SEQ ID 611) and oBP963 (SEQ ID 612), each containing an EcoRI restriction site. The resulting PCR product and pLA59 (SEQ ID 591) were ligated together after digestion with EcoRI. pLA59 contains a URA3 marker flanked by degenerate loxP sites. The URA3-xpk-eutD integration cassette from the resulting plasmid was amplified with oBP988 (SEQ ID 613), containing a 5' tail with homology to the sequence upstream of PDC5, and oBP989 (SEQ ID 614), containing a 5' tail with homology to the sequence downstream of PDC5. PNY2056 was transformed with the resulting PCR product and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. A strain that had the phosphoketolase and phosphotransacetylase expression cassette correctly integrated at the pdc5Δ::loxP locus and had the URA3 marker and CRE plasmid removed was designated PNY1558.

Construction of Promoter-alsS Integration Plasmids pBP2640, pBP2641, pBP2662, pBP2666, pBP2728, pBP2730, and pBP2732 pBP2234 was derived from pUC19-URA3MCS. pUC19-URA3MCS is pUC19 based and contains the sequence of the URA3 gene from *Saccharomyces cerevisiae* situated within a multiple cloning site (MCS). pUC19 contains the pMB1 replicon and a gene coding for beta-lactamase for replication and selection in *Escherichia coli*. In addition to the coding sequence for URA3, the sequences from upstream and downstream of this gene were included for expression of the URA3 gene in yeast. The vector can be used for cloning purposes and can be used as a yeast integration vector. pBP2234 was constructed by removing the URA3 marker from pUC19-URA3MCS and replacing it with the URA3 marker flanked by degenerate loxP sites and primer binding sites from pLA59 (SEQ ID 591). pUC19-URA3MCS was digested with NotI and FseI and the resulting large fragment was gel purified. The URA3 marker flanked by degenerate loxP sites and primer binding sites in pLA59 was amplified with oBP880 (SEQ ID 616), containing a FseI restriction site, and oBP881 (SEQ ID 617), containing a NotI restriction site. The resulting PCR product was digested with FseI and NotI and then ligated with the gel purified large fragment from pUC19-URA3MCS. The resulting plasmid was designated pBP2234 (SEQ ID 618).

Integration plasmids were made for integration of promoter-alsS constructs into the pdc1Δ::loxP locus of PNY1558. First, 250 bp of DNA, spanning the sequence 751 to 1000 bp upstream of the PDC1 coding sequence, was cloned into pBP2234. This sequence created the homology necessary for integration by homologous recombination and in doing so would also lead to deletion of the PDC1 promoter. The 250 bp upstream homology region was amplified from PNY0827 genomic DNA using primers oBP1167 (SEQ ID 619), containing a PmeI restriction site, and oBP1168 (SEQ ID 620), containing a FseI restriction site. The resulting PCR product was ligated into pBP2234, after digestion with the appropriate enzymes, to create plasmid pBP2638. The *Bacillus subtilis* alsS gene was amplified from plasmid pYZ090 (SEQ ID NO: 621) using primers oBP1169 (SEQ ID 622), containing a PadI restriction site, and oBP1170 (SEQ ID 623), containing a SalI restriction site. The HXT3 promoter region was amplified from *Saccharomyces cerevisiae* CEN.PK 113-7D genomic DNA using primers oBP1165 (SEQ ID 624), containing a NotI restriction site, and oBP1166 (SEQ ID 625), containing a PadI restriction site. The PCR products of the HXT3 promoter region and alsS were ligated into pBP2638, after digestion with the appropriate enzymes, to create plasmid pBP2640 (SEQ ID 626). The HXT1 promoter region was amplified from *Saccharomyces cerevisiae* CEN.PK 113-7D genomic DNA using primers oBP1163 (SEQ ID 627), containing a NotI restriction site, and oBP1164 (SEQ ID 628), containing a PadI restriction site. The PCR products of the HXT1 promoter region and alsS were ligated into pBP2638, after digestion with the appropriate enzymes, to create plasmid pBP2641 (SEQ ID 629).

A 261 bp segment of DNA downstream of PDC1, starting at the first by after the PDC1 stop codon, was cloned into pBP2640. The 261 bp region was amplified from PNY0827 genomic DNA using primers oBP1205 (SEQ ID 630), containing a XhoI restriction site, and oBP1206 (SEQ ID 631), containing a SalI restriction site. The resulting PCR product was ligated into pBP2640, after digestion of the PCR product with XhoI and SalI and digestion of pBP2640 with SalI, to create plasmid pBP2662 (SEQ ID 632).

pBP2640 was digested with NotI and PacI and the large fragment was gel purified to remove the HXT3 promoter. The ANB1 promoter region was amplified from *Saccharomyces cerevisiae* CEN.PK 113-7D genomic DNA using primers oBP1211 (SEQ ID 633), containing a NotI restriction site, and oBP1212 (SEQ ID 634), containing a PacI restriction site. The PCR product of the ANB1 promoter region was digested with the appropriate enzymes and ligated with the digested pBP2640 large fragment to create plasmid pBP2666 (SEQ ID 635). The TIR1 promoter region was amplified from *Saccharomyces cerevisiae* CEN.PK 113-7D genomic DNA using primers HY183 (SEQ ID 636), containing a NotI restriction site, and HY184 (SEQ ID 637), containing a PacI restriction site. The PCR product of the TIR1 promoter region was digested with the appropriate enzymes and ligated with the digested pBP2640 large fragment to create plasmid pBP2728 (SEQ ID 638). The HEM13 promoter region was amplified from *Saccharomyces cerevisiae* CEN.PK 113-7D genomic DNA using primers HY185 (SEQ ID 639), containing a NotI restriction site, and HY186 (SEQ ID 640), containing a PacI restriction site. The PCR product of the HEM13 promoter region was digested with the appropriate enzymes and ligated with the digested pBP2640 large fragment to create plasmid pBP2730 (SEQ ID 641). The HES1 promoter region was amplified from *Saccharomyces cerevisiae* CEN.PK 113-7D genomic DNA using primers HY187 (SEQ ID 642), containing a NotI restriction site, and HY188 (SEQ ID 643), containing a PacI restriction site. The PCR product of the HES1 promoter region was digested with the appropriate enzymes and ligated with the digested pBP2640 large fragment to create plasmid pBP2732 (SEQ ID 644).

Construction of Strains PNY1559, PNY1560, PNY1561, PNY1562, PNY1623, PNY1624, PNY1625, PNY1626, and PNY1627

Strains were constructed to express the alsS gene from a single-copy integration on a chromosome. The final four enzymes of the isobutanol pathway were carried on multicopy plasmids. pHR81-ILV5p-K9JB was constructed to contain a chimeric gene having the coding region of the K9JB4P variant ilvC gene from *Anaerostipes caccae* (nt 8-1036) expressed from the yeast ILV5 promoter (nt 8420-9613) and followed by the ILV5 terminator (nt 1065-1687) for expression of KARI. pLA84 was constructed to contain a chimeric gene having the coding region of the ilvD gene from *Streptococcus mutans* (nt position 5876-7588) expressed from the yeast FBA1 promoter (nt 5277-5866) and followed by the FBA1 terminator (nt 7621-7933) for expression of DHAD, a chimeric gene having the coding region of the adh gene from *Beijerinckia indica* codon optimized for expression in *Saccharomyces cerevisiae* (nt 9339-8296) expressed from the yeast GPM1 promoter (nt 10107-9351) and followed by the ADH1 terminator (nt 8287-7972) for expression of ADH, and a chimeric gene having the coding region of the kivD gene from *Listeria grayi* codon optimized for expression in *Saccharomyces cerevisiae* (nt 12353-10707) expressed from the yeast TDH3 promoter (nt 13017-12354) and followed by the TDH3 terminator (nt 10706-10114) for expression of ADH.

PNY1558 was transformed with plasmids pHR81-ILV5p-K9JB (SEQ ID NO: 645) and pLA84 (SEQ ID NO: 646) and transformants were selected for growth on synthetic complete media lacking uracil and histidine and supplemented with 1% ethanol at 30 C. A transformant was designated as PNY1559; a no alsS control strain.

The URA3-P[HXT3]-alsS integration cassette was amplified from pBP2640 with primer oBP1167 (SEQ ID 619) and primer oBP1204 (SEQ ID 647), containing a 5' tail with homology to the sequence downstream of PDC1. PNY1558 was transformed with the resulting PCR product and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the P[HXT3]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1560.

The URA3-P[HXT1]-alsS integration cassette was amplified from pBP2641 with primer oBP1167 (SEQ ID 619) and primer oBP1204 (SEQ ID 647), containing a 5' tail with homology to the sequence downstream of PDC1. PNY1558 was transformed with the resulting PCR product and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the P[HXT1]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1561.

The alsS-CYC1t-URA3 cassette, with URA3 flanked by degenerate loxP sites, was amplified from pLA71 (SEQ ID 649) with primer 895 (SEQ ID 650), containing a 5' tail with homology to the 60 bp immediately upstream of the PDC1 coding sequence, and primer 679 (SEQ ID 651), containing a 5' tail with homology towards the 3' end of PDC1 (nucleotides 1590-1639 of PDC1). PNY1558 was transformed with the resulting PCR product and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the alsS-CYC1t expression cassette correctly integrated at the pdc1Δ::loxP locus, with expression of alsS by the PDC1 promoter, and that had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1562.

The URA3-P[ANB1]-alsS integration cassette was released from pBP2666 by digesting the plasmid with SalI and PmeI. PNY1558 was transformed with the resulting digested plasmid and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the P[ANB1]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1623.

The URA3-P[TIR1]-alsS integration cassette was released from pBP2728 by digesting the plasmid with SalI and PmeI. PNY1558 was transformed with the resulting digested plasmid and transformants were selected for growth on synthetic complete media lacking uracil supplemented with 1% ethanol at 30 C. For two independent transformants, integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. Two independent isolates that had the P[TIR1]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant from each independent integrant was selected and were designated as PNY1624 and PNY1625.

The URA3-P[HEM13]-alsS integration cassette was released from pBP2730 by digesting the plasmid with SalI and PmeI. PNY1558 was transformed with the resulting digested plasmid and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the P[HEM13]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1626.

The URA3-P[HES1]-alsS integration cassette was released from pBP2732 by digesting the plasmid with SalI and PmeI. PNY1558 was transformed with the resulting digested plasmid and transformants were selected for growth on synthetic complete media lacking uracil supplemented with 1% ethanol at 30 C. Integrations at the correct site were identified by PCR and the URA3 marker was removed by transforming with pJT254 (SEQ ID 615), containing the CRE recombinase under the GAL1 promoter, and plating on synthetic complete medium lacking histidine and supplemented with 1% ethanol at 30° C. After verifying removal of the URA3 marker by PCR, strains were grown in YPE (1% ethanol) to remove the CRE plasmid. An isolate that had the P[HES1]-alsS expression cassette correctly integrated at the pdc1Δ::loxP locus with deletion of the PDC1 promoter and had the URA3 marker and CRE plasmid removed was transformed with plasmids pHR81-ILV5p-K9JB and pLA84 and transformants were selected for growth on synthetic complete media lacking uracil and histidine and supplemented with 1% ethanol at 30 C. A transformant was designated as PNY1627.
Creation of PNY2145 from PNY2115

PNY2145 was constructed from PNY2115 by the additional integration of a phosphoketolase gene cassette at the pdc5A locus and by replacing the native AMN1 gene with a codon optimized version of the ortholog from CEN.PK. Integration constructs are further described below.
pdc5Δ::FBA(L8)-xpk1-CYC1t-loxP71/66

The TEF(M4)-xpk1-CYC1t gene from pRS423::TEF(M4)-xpk1+ENO1-eutD (SEQ ID NO: 561) was PCR amplified using primers N1341 and N1338 (SEQ ID Nos. 652 and 653), generating a 3.1 kb product. The loxP-flanked URA3 gene cassette from pLA59 (SEQ ID NO: 591) was amplified with primers N1033c and N1342 (SEQ ID Nos. 654 and 655), generating a 1.6 kb product. The xpk1 and URA3 PCR products were fused by combining them without primers for an additional 10 cycles of PCR using Phusion DNA polymerase. The resulting reaction mix was then used as a template for a PCR reaction with KAPA Hi Fi and primers N1342 and N1364 (SEQ ID Nos. 655 and 656). A 4.2 kb PCR product was recovered by purification from an electrophoresis agarose gel (Zymo kit). FBA promoter variant L8 (SEQ ID No. 657) was amplified using primers N1366 and N1368 (SEQ ID Nos. 658 and 659). The xpk1::URA3 PCR product was combined with the FBA promoter by additional rounds of PCR. The resulting product was phosphorylated with polynucleotide kinase and ligated into pBR322 that had been digested with EcoRV and treated with calf intestinal phosphatase. The ligation reaction was transformed into *E. coli* cells (Stb13 competent cells from Invitrogen). The integration cassette was confirmed by sequencing. To prepare DNA for integration, the plasmid was used as a template in a PCR reaction with Kapa HiFi and primers N1371 and N1372 (SEQ ID Nos. 660 and 661). The PCR product was isolated by phenol-chloroform extraction and ethanol precipitation (using standard methods; eg. Maniatas, et al.). Five micrograms of DNA were used to transform strain PNY2115. Transformants were selected on medium lacking uracil (synthetic complete medium minus uracil with 1% ethanol as the carbon source). Colonies were screened for the integration event using PCR (JumpStart) with primers BK93 and N1114 (SEQ ID Nos. 662 and 567). Two clones were selected to carry forward. The URA3 marker was recycled by transforming with pJT254 (SEQ ID NO: 615) containing the CRE recombinase under the GAL1 promoter and plating on synthetic complete medium lacking histidine and supplemented with 1% ethanol at 30° C. Transformants were grown in rich medium supplemented with 1% ethanol to derepress the recombinase. Marker removal was confirmed for single colony isolates by patching to synthetic complete medium lacking uracil and supplemented with 1% ethanol to verify absence of growth. Loss of the recombinase plasmid, pJT254, was confirmed by patching the colonies to synthetic complete medium lacking histidine and supplemented with 1% ethanol. Proper marker removal was confirmed by PCR (primers N160SeqF5 (SEQ ID NO: 559) and BK380. One resulting clone was designated PNY2293.
amn1Δ::AMN1(y)-loxP71/66

To replace the endogenous copy of AMN1 with a codon-optimized version of the AMN1 gene from CEN.PK2, an integration cassette containing the CEN.PK AMN1 promoter, AMN1(y) gene (nucleic acid SEQ ID NO: 666; amino acid SEQ ID NO: 664), and CEN.PK AMN1 terminator was assembled by SOE PCR and subcloned into the shuttle vector pLA59. The AMN1(y) gene was ordered from DNA 2.0 with codon-optimization for *S. cerevisiae*. The completed pLA67 plasmid (SEQ ID NO: 667) contained: 1) pUC19 vector backbone sequence containing an *E. coli* replication origin and ampicillin resistance gene; 2) URA3 selection marker flanked by loxP71 and loxP66 sites; and 3) $P_{AMN1(CEN.PK)}$-AMN1(y)-term$_{AMN1(CEN.PK)}$ expression cassette.

PCR amplification of the AMN1(y)-loxP7'-URA3-loxP66 cassette was done by using KAPA HiFi from Kapa Biosystems, Woburn, Mass. and primers LA712 (SEQ ID NO: 668) and LA746 (SEQ ID NO: 669). The PCR product was transformed into PNY2293 using standard genetic techniques and transformants were selected on synthetic complete medium lacking uracil and supplemented with 1% ethanol at 30° C. Transformants were observed under magnification for the absence of a clumping phenotype with respect to the control (PNY2293). The URA3 marker was recycled using the pJT254 Cre recombinase plasmid as described above. After marker recycle, clones were again observed under magnification to confirm absence of the clumping phenotype. A resulting identified strain, PNY2145, has the genotype: MATa ura3Δ::loxP his3Δ pdc5Δ::P[FBA(L8)]-XPK|xpk1_Lp-CYCt-loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66 amn1Δ::AMN1(y)
Construction of Strains PNY1631, PNY1632, PNY1633, PNY1634, PNY1635, and PNY1636

Isobutanologen strains that also contain promoter-GFP (green fluorescent protein) fusions were constructed. Plasmids containing promoter-GFP fusions were based on pRS413 (ATCC#87518), a centromeric shuttle vector. The gene for the GFP protein ZsGreen (Clontech, Mountain View, Calif.) was cloned downstream of different promoters in pRS413.
Construction of PNY2115 from PNY2050

Construction of PNY2115 [MATa ura3Δ::loxP his3Δ pdc5Δ::loxP66/71 fra2Δ 2-micron plasmid (CEN.PK2) pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66 gpd2Δ::loxP71/66] from PNY2050 was as follows:

a. pdc1Δ::P[PDC1]-ALS|alsS_Bs-CYC1t-loxP71/66

To integrate alsS into the pdc1Δ::loxP66/71 locus of PNY2050 using the endogenous PDC1 promoter, an integration cassette was PCR-amplified from pLA71 (SEQ ID NO:810), which contains the gene acetolactate synthase from the species *Bacillus subtilis* with a FBA1 promoter and a CYC1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 895 (SEQ ID NO:813) and 679 (SEQ ID NO:814). The PDC1 portion of each primer was derived from 60 nucleotides of the upstream of the coding sequence and 50 nucleotides that are 53 nucleotides upstream of the stop codon. The PCR product was transformed into PNY2050 using standard genetic techniques and transformants were selected on synthetic complete media lacking uracil and supplemented with 1% ethanol at 30° C. Transformants were screened to verify correct integration by colony PCR using primers 681 (SEQ ID NO:815), external to the 3' coding region and 92 (SEQ ID NO:816), internal to the URA3 gene. Positive transformants were then prepped for genomic DNA and screened by PCR using primers N245 (SEQ ID NO:817) and N246 (SEQ ID NO:818). The URA3 marker was recycled by transforming with pLA34 (SEQ ID NO:804) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2090 has the genotype MATa ura3Δ::loxP, his3Δ, pdc1Δ::loxP71/66, pdc5Δ::loxP71/66 fra2Δ 2-micron pdc1Δ::P[PDC1]-ALS|alsS_Bs-CYC1t-loxP71/66.

b. pdc6Δ::(UAS)PGK1-P[FBA1]-KIVD|Lg(y)-TDH3t-loxP71/66

To delete the endogenous PDC6 coding region, an integration cassette was PCR-amplified from pLA78 (SEQ ID NO:811), which contains the kivD gene from the species *Listeria grayi* with a hybrid FBA1 promoter and a TDH3 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 896 (SEQ ID NO:819) and 897 (SEQ ID NO:820). The PDC6 portion of each primer was derived from 60 nucleotides upstream of the coding sequence and 59 nucleotides downstream of the coding region. The PCR product was transformed into PNY2090 using standard genetic techniques and transformants were selected on synthetic complete media lacking uracil and supplemented with 1% ethanol at 30° C. Transformants were screened to verify correct integration by colony PCR using primers 365 (SEQ ID NO:821) and 366 (SEQ ID NO:822), internal primers to the PDC6 gene. Transformants with an absence of product were then screened by colony PCR N638 (SEQ ID NO:823), external to the 5' end of the gene, and 740 (SEQ ID NO:824), internal to the FBA1 promoter. Genomic DNA was prepared from positive transformants and screened by PCR with two external primers to the PDC6 coding sequence. Positive integrants would yield a 4720 nucleotide long product, while PDC6 wild type transformants would yield a 2130 nucleotide long product. The URA3 marker was recycled by transforming with pLA34 containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain is called PNY2093 and has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66.

c. adh1Δ::P[ADH1]-ADH|Bi(y)-ADHt-loxP71/66

To delete the endogenous ADH1 coding region and integrate BiADH using the endogenous ADH1 promoter, an integration cassette was PCR-amplified from pLA65 (SEQ ID NO:812), which contains the alcohol dehydrogenase from the species *Beijerinckii indica* with an ILV5 promoter and a ADH1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 856 (SEQ ID NO:825) and 857 (SEQ ID NO:826). The ADH1 portion of each primer was derived from the 5' region 50 nucleotides upstream of the ADH1 start codon and the last 50 nucleotides of the coding region. The PCR product was transformed into PNY2093 using standard genetic techniques and transformants were selected on synthetic complete media lacking uracil and supplemented with 1% ethanol at 30° C. Transformants were screened to verify correct integration by colony PCR using primers BK415 (SEQ ID NO:827), external to the 5' coding region and N1092 (SEQ ID NO:828), internal to the BiADH gene. Positive transformants were then screened by colony PCR using primers 413 (SEQ ID NO:829), external to the 3' coding region, and 92 (SEQ ID NO:816), internal to the URA3 marker. The URA3 marker was recycled by transforming with pLA34 (SEQ ID NO:804) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2101 has the genotype MATa ura3Δ::loxP his3Δ pdc5Δ::loxP71/66 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH|Bi(y)-ADHt-loxP71/66.

d. fra2Δ::P[ILV5]-ADH|Bi(y)-ADHt-loxP71/66

To integrate BiADH into the fra2Δ locus of PNY2101, an integration cassette was PCR-amplified from pLA65 (SEQ ID NO:812), which contains the alcohol dehydrogenase from the species *Beijerinckii indica* with an ILV5 promoter and an ADH1 terminator, and a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers 906 (SEQ ID NO:831) and 907 (SEQ ID NO:832). The FRA2 portion of each primer was derived from the first 60 nucleotides of the coding sequence starting at the ATG and 56 nucleotides downstream of the stop codon. The PCR product was transformed into PNY2101 using standard genetic techniques and transformants were selected on synthetic complete media lacking uracil and supplemented with 1% ethanol at 30° C. Transformants were screened to verify correct integration by colony PCR using primers 667 (SEQ ID NO:817), external to the 5' coding region and 749 (SEQ ID NO:833), internal to the ILV5 promoter. The URA3 marker was recycled by transforming with pLA34 (SEQ ID NO:804) containing the CRE recombinase under the GAL1 promoter and plated on synthetic complete media lacking histidine and supplemented with 1% ethanol at 30° C. Transformants were plated on rich media supplemented with 1% ethanol and 0.5% galactose to induce the recombinase. Marker removal was confirmed by patching colonies to synthetic complete media lacking uracil and supplemented with 1% ethanol to verify absence of growth. The resulting identified strain, called PNY2110 has the genotype MATa ura3Δ::loxP his3Δ pdc5Δ:: loxP66/71 2-micron pdc1Δ::P[PDC1]-ALS|alsS_Bs-CYC1t-loxP71/66 pdc6Δ::(UAS)PGK1-P[FBA1]-KIVD|Lg (y)-TDH3t-loxP71/66 adh1Δ::P[ADH1]-ADH|Bi(y)-ADHt-loxP71/66 fra2Δ::P[ILV5]-ADH|Bi(y)-ADHt-loxP71/66.

e. GPD2 Deletion

To delete the endogenous GPD2 coding region, a deletion cassette was PCR amplified from pLA59 (SEQ ID NO:834), which contains a URA3 marker flanked by degenerate loxP sites to allow homologous recombination in vivo and subsequent removal of the URA3 marker. PCR was done by using the KAPA HiFi™ PCR Kit (Kapabiosystems, Woburn, Mass.) and primers LA512 (SEQ ID NO:805) and LA513 (SEQ ID NO:806). The GPD2 portion of each primer was derived from the 5' region 50 nucleotides upstream of the GPD2 start codon and 3' region 50 nucleotides downstream of the stop codon such that integration of the URA3 cassette results in replacement of the entire GPD2 coding region. The PCR product was transformed into PNY2110 using standard genetic techniques and transformants were selected on synthetic complete medium lacking uracil and supplemented with 1% ethanol at 30° C. Transformants were screened to verify correct integration by colony PCR using primers LA516 (SEQ ID NO:807) external to the 5' coding region and LA135 (SEQ ID NO:803), internal to URA3. Positive transformants were then screened by colony PCR using primers LA514 (SEQ ID NO:808) and LA515 (SEQ ID NO:809), internal to the GPD2 coding region. The URA3 marker was recycled by transforming with pLA34 (SEQ ID NO:804) containing the CRE recombinase under the GAL1 promoter and plated on synthetic complete medium lacking histidine and supplemented with 1% ethanol at 30° C. Transformants were plated on rich medium supplemented with 1% ethanol and 0.5% galactose to induce the recombinase. Marker removal was confirmed by patching colonies to synthetic complete medium lacking uracil and supplemented with 1% ethanol to verify absence of growth. The resulting identified strain, called PNY2115, has the genotype MATa ura3Δ::loxP his3Δ pdc5Δ::loxP66/71 fra2Δ 2-micron pdc1Δ::P[PDC1]-ALS|alsS_Bs-CYC1t-loxP71/66 pdc6Δ::(UAS)PGK1-P[FBA1]-KIVD|Lg(y)-TDH3t-loxP71/66 adh1Δ::P[ADH1]-ADH1Bi(y)-ADHt-loxP71/66 fra2Δ::P[ILV5]-ADH|Bi(y)-ADHt-loxP71/66 gpd2Δ::loxP71/66.

pBP3836 (SEQ ID NO: 670) was constructed to contain the coding region of ZsGreen (nt 2716-3411) expressed from the yeast FBA1 promoter (nt 2103-2703) and followed by the FBA1 terminator (nt 3420-4419). pBP3840 (SEQ ID NO: 671) was constructed to contain the coding region of ZsGreen (nt 2891-3586) expressed from the engineered promoter FBA1::HXT1_331 (described herein; nt 2103-2878) and followed by the FBA1 terminator (nt 3595-4594). pBP3933 (SEQ ID NO: 672) was constructed to contain the coding region of ZsGreen (nt 2764-3459) expressed from the yeast ADH2 promoter (nt 2103-2751) and followed by the FBA1 terminator (nt 3468-4467). pBP3935 (SEQ ID NO: 673) was constructed to contain the coding region of ZsGreen (nt 3053-3748) expressed from the yeast HXT5 promoter (nt 2103-3040) and followed by the FBA1 terminator (nt 3757-4756). pBP3937 (SEQ ID NO: 674) was constructed to contain the coding region of ZsGreen (nt 3115-3810) expressed from the yeast HXT7 promoter (nt 2103-3102) and followed by the FBA1 terminator (nt 3819-4818). pBP3940 (SEQ ID NO: 675) was constructed to contain the coding region of ZsGreen (nt 3065-3760) expressed from the yeast PDC1 promoter (nt 2103-3052) and followed by the FBA1 terminator (nt 3769-4768).

pLH689::I2V5 (SEQ ID NO: 676) was constructed to contain a chimeric gene having the coding region of the K9JB4P variant ilvC gene from *Anaeropstipes cacae* (nt 1628-2659) expressed from the yeast ILV5 promoter (nt 427-1620) and followed by the ILV5 terminator (nt 2685-3307) for expression of KARI and a chimeric gene having the coding region of the I2V5 variant ilvD gene from *Streptococcus mutans* (nucleotides 5377-3641) expressed from the yeast TEF1 mutant 7 promoter (nt 5787-5387; Nevoigt et al. 2006. Applied and Environmental Microbiology, v72 p5266) and followed by the FBA1 terminator (nt 3632-3320) for expression of DHAD.

PNY2145 was transformed with plasmid pLH689::I2V5 and a plasmid containing one of the promoter-GFP fusions. Transformants were selected for growth on synthetic complete media lacking uracil and histidine and supplemented with 1% ethanol at 30 C. PNY2145 was transformed with plasmids pLH689::I2V5 and pBP3836 and a transformant was designated PNY1631. PNY2145 was transformed with plasmids pLH689::I2V5 and pBP3840 and a transformant was designated PNY1632. PNY2145 was transformed with plasmids pLH689::I2V5 and pBP3933 and a transformant was designated PNY1633. PNY2145 was transformed with plasmids pLH689::I2V5 and pBP3935 and a transformant was designated PNY1634. PNY2145 was transformed with plasmids pLH689::I2V5 and pBP3935 and a transformant was designated PNY1634. PNY2145 was transformed with plasmids pLH689::I2V5 and pBP3940 and a transformant was designated PNY1634.

Construction of Strain PNY2332 and PNY2289

PNY2332

An oxygen-regulated hybrid promoter was constructed by cloning a 95 base-pair aerobic repressor sequence from the *S. cerevisiae* DAN1 promoter into the *S. cerevisiae* FBA1 promoter. Two constructs were built, one for initial hybrid promoter testing using the beta-glucuronidase (GUS) gene as the reporter and a second construct for integration of the URA3::P[FBA1::DAN1_314]-alsS cassette into the Δpdc1::loxP71/66 locus of *S. cerevisiae* strain PNY1558.

The aerobic repressor sequence from the DAN1 promoter was PCR amplified from a genomic DNA template prepared from *S. cerevisiae* strain BY4743 (available from American Type Culture Collection, Manassas, Va., #201390) using forward and reverse primers N1387 (SEQ ID NO 677) and N1388 (SEQ ID NO 678) (based on the GenBank S288c sequence, ATCC #204508) each containing a 5' engineered BlpI restriction site that resulted in a 119 base pair PCR product. Amplification was carried out using a hot start DNA polymerase (Phusion, New England BioLabs, Ipswich, Mass.). The resulting PCR product was restriction digested with BlpI and bidirectionally cloned into the BlpI site of the FBA1 promoter sequence in plasmid pRS316-FBA1p-GUS (described in US App. Pub. No. 20120237988 and PCT. App. Pub. No. WO/2012/129555, each incorporated herein by reference), previously linearized with BlpI, using a standard ligation protocol. The ligated DNA was transformed into *E. coli* TOP10 chemically competent cells and plated on a selective medium. Clones containing the new construct were isolated by PCR colony screening several transformants using forward and reverser check primers N1389 (SEQ ID NO 680) and N1411 (SEQ ID NO 681), respectively. Plasmids prepared from several clones were sequenced to verify the desired direction and sequence of the aerobic repressor insert using primers GUS729R (SEQ ID NO 682), N1310 (SEQ ID NO 683) and N1311 (SEQ ID NO 684). The new construct was designated pJT314. The hybrid FBA1 promoter was designated P[FBA1::DAN1_AR314] (SEQ ID NO 686).

A P[FBA1::DAN1_AR314] integration cassette was constructed for expression of the B. subtilis alsS gene from the Δpdc1 locus in S. cerevisae strain PNY1558. P[FBA1::DAN1_AR314] was PCR amplified from plasmid pJT314 using primers N1443 (SEQ ID NO 687) and N1444 (SEQ ID NO 688) containing engineered NotI and PadI restriction sites, respectively. Amplification was carried out using a hot start DNA polymerase (Phusion—New England BioLabs). The 726 base pair PCR product was restriction digested with NotI and Pad and directionally cloned into the integration vector pBP2662 (SEQ ID NO: 632) previously restriction digested with NotI and Pad using the T4 DNA Ligase Kit (regular concentration) according to the manufacturer's instructions (New England BioLabs, Ipswich, Mass.). The ligated DNA was transformed into E. coli TOP10 chemically competent cells and plated on a selective medium. Clones containing the new construct were isolated by PCR colony screening several transformants using forward and reverse check primers N1452 (SEQ ID NO 690) and N1457 (SEQ ID NO 691), respectively. Plasmids prepared from several clones were sequenced to verify the hybrid promoter insert sequence using primers N1445 (SEQ ID NO 692), N1446 (SEQ ID NO 693), N1447 (SEQ ID NO 694), N1448 (SEQ ID NO 695), N1452 and N1459 (SEQ ID NO 690 and 696). The new construct was designated pJT336 (SEQ ID NO 697).

Plasmid pJT336 was restriction digested with PmeI and SalI to release a 4,715 base pair linear integration cassette containing the URA3 marker and P[FBA1::DAN1_AR314]-alsS expression cassettes flanked by upstream and downstream sequences homologous to the Δpdc1::loxP71/66 locus. The linearized integration cassette was transformed into S. cerevisae strain PNY1558 for integration by homologous recombination using a standard yeast transformation protocol. The transformed cells were plated onto SE 1.0% medium minus uracil for selection of Δpdc1::loxP71-URA3-loxP66::P[FBA1::DAN1_AR314]-alsS integrants. Putative integrants were verified by PCR colony screening the 5' and 3' ends of the integration site using primers N1463 (SEQ ID NO 698), N1464 (SEQ ID NO 699), N1465 (SEQ ID NO 700) and N1466 (SEQ ID NO 701). The URA3 marker was removed from the integration site by cleavage at the loxP sites by expressed cre-recombinase from plasmid pJT254. URA3 marker removal was verified in several clones by plating on selective and non-selective media where a negative growth phenotype on media lacking uracil was evidence for marker removal. PCR colony screening of the 5' and 3' ends of the integration locus using primers N1463 (SEQ ID NO 698) and N1467 (SEQ ID NO 702), N1465 and N1466, respectively, further verified URA3 marker loss and the integrity of the Δpdc1::loxP71/66::P[FBA1-DAN1_AR314]-alsS locus. The resulting strain is PNY2332.

PNY2289

A glucose-regulated hybrid promoter was constructed by cloning a 168 base-pair glucose repressor sequence from the S. cerevisiae HXT1 promoter into the S. cerevisiae FBA1 promoter. Two constructs were built, one for initial hybrid promoter testing using the green fluorescent protein ZsGreen (Clontech; Mountain View, Calif.; Matz et al, Nature Biotechnology (1999) 17:969; Lukyanov et al,] BC (2000) 275 (34): 25879) gene as the reporter and the second construct for integration of the URA3::P[FBA1::HXT1-331]-alsS cassette into the Δpdc1::loxP71/66 locus of S. cerevisiae strain PNY1558.

The gene for ZsGreen was PCR amplified from plasmid pZsGreen (Clontech, Mountain View, Calif.) using primers N1316 (SEQ ID NO 703) and N1317 (SEQ ID NO 704) with engineered 5' restriction sites SpeI and NotI, respectively, resulting in a 723 base pair product. The ZsGreen PCR product was restriction digested with SpeI and NotI and directionally cloned into plasmid pRS316-FBA1-GUS (described in US App. Pub. No. 20120237988 and PCT. App. Pub. No. WO/2012/129555, both incorporated herein by reference) previously digested with SpeI and NotI to replace the GUS gene and resulting in plasmid pJT257 (SEQ ID NO 705). The glucose-repressor sequence from the HXT1 promoter was PCR amplified from a genomic DNA template prepared from S. cerevisiae strain BY4743 using primers N1424 (SEQ ID NO 706) and N1425 (SEQ ID NO 707) (based on the S288c genomic sequence; ATCC #204508) each containing a 5' engineered BlpI restriction site resulting in a 190 base pair PCR product. Amplification was carried out using a hot start DNA polymerase (Phusion—New England BioLabs). The resulting PCR product was restriction digested with BlpI and bidirectionally cloned into the BlpI site of the FBA1 promoter sequence residing in plasmid pJT257 previously linearized with BlpI. The ligated DNA was transformed into E. coli TOP10 chemically competent cells and plated on a selective medium. Plasmid DNA from several transformants was isolated and the presence and direction of the HXT1 glucose repressor insert screened by sequencing using primers N1314 (SEQ ID NO 708) and N1323 (SEQ ID NO 709). The new construct was designated pJT331 (SEQ ID NO 710). The hybrid FBA1 promoter was designated P[FBA1::HXT1_331] (SEQ ID NO 711).

A P[FBA1::HXT1_331] integration cassette was constructed for expression of the B. subtilis alsS gene from the Δpdc1 locus in S. cerevisae corn strain PNY1558. P[FBA1::HXT1_331] was PCR amplified from plasmid pJT331 using primers N1453 (SEQ ID NO 712) and N1454 (SEQ ID NO 713) containing engineered NotI and Pad restriction sites, respectively. Amplification was carried out using a hot start DNA polymerase (Phusion—New England BioLabs). The 798 base pair PCR product was restriction digested with NotI and Pad and directionally cloned into the integration vector pBP2662 (SEQ ID NO: 632) previously restriction digested with NotI and Pad. The ligated DNA was transformed into E. coli TOP10 chemically competent cells and plated on a selective medium. Clones containing the new construct were isolated by PCR colony screening several transformants using forward and reverse check primers N1434 (SEQ ID NO 715) and N1446, respectively. Plasmids prepared from several clones were sequenced to verify the promoter sequence insert using primers N1434, N1445, N1446, and N1459. The new construct was designated pJT337 (SEQ ID NO 716).

Plasmid pJT337 was restriction digested with PmeI and SalI to release a 4,595 base pair linear integration cassette containing URA3 and P[FBA1::HXT1_331]-alsS expression cassettes flanked by upstream and downstream sequences homologous to the Δpdc1::loxP71/66 locus. The linearized integration cassette was transformed into S. cerevisiae strain PNY1558 for integration by homologous recombination using a standard yeast transformation protocol. The transformed cells were plated onto SE 1.0% medium minus uracil for selection of pdc1::loxP71-URA3-loxP66::P[FBA1::HXT1_331] alsS integrants. Putative integrants were verified by PCR colony screening for the 5' and 3' ends of the integration site using primers N1463, N1464, N1434 and N1446. The URA marker was removed from the integration site by cleavage at the loxP sites by expression of cre-recombinase from plasmid pJT254. URA3 marker removal was verified in several clones by plating on selective and non-selective media where a negative growth phenotype on media lacking uracil was evidence for marker removal. PCR colony screening of the 5' and 3' ends of the integration locus using primers N1463 and N1468 (SEQ ID NO 717), N1434 and N1446, respectively, were used to further verify URA3 marker loss and the integrity of the pdc1::loxP71/66::P[FBA1-HXT1_331]-alsS locus. The resulting strain was designated PNY2289.

Example 2

Overview of Promoter Prospecting

A "promoter prospecting" experiment was carried out as set forth below to examine the pattern of gene expression in an isobutanologen resulting from the transition from propagation to isobutanol production. RNA was extracted at the end of the propagation culture, and at 3 points during the production culture. Microarray analysis identified a number of genes that were up-regulated (up to 200-fold) and highly expressed in one or more timepoints during production, but not in the propagation sample. Twelve of these were selected for further study; their promoters were fused to the green fluorescent protein (GFP) as a reporter for expression, and their transcriptional activity was monitored during fermentation (including scaled-down models of simultaneous saccharification and fermentation). The twelve genes are tabulated in Table 1. They include IMA1, encoding isomaltase (involved in fermentation of residual sugars produced by α-amylase-catalyzed starch hydrolysis), genes induced by cell wall damage, genes involved in thermotolerance and halotolerance, in pseudohyphal growth (known to be induced by isobutanol), and genes encoding proteasomal subunits (the proteasome degrades misfolded proteins, which increase in abundance under certain kinds of stress).

The promoters that were identified through promoter prospecting would not necessarily have been selected based on a rational, a priori, approach. It may be necessary to periodically repeat promoter prospecting experiments, as isobutanologen strains and processes evolve. Also, promoters of genes that displayed dynamic expression profiles during this promoter prospecting experiment may also be screened for utility in a second round of testing.

The induction of the IMA1 gene, observed in the promoter prospecting experiment, may be in response to maltrins present in the corn mash. Yeast has an active transcriptional response to corn oil fatty acid fractions, particularly oleic acid, resulting in the activation of genes involved in peroxisomal biogenesis and function. This response is over-ridden by glucose repression.

In studies of transcriptional responses to isobutanol challenge, a number of genes were observed to be induced, including GRE2 (encoding 3-methylbutanal reductase), PDR5 (encoding a drug-efflux pump), and heat shock genes. Upon fusing the GRE2 promoter to a gene encoding GFP, it was determined that GFP expression is indeed activated by isobutanol challenge.

Promoter Prospecting Experiment

The purpose of this experiment was to simulate an isobutanol fermentation of corn mash so that responsive promoters could be identified for subsequent exploitation. An aerobic propagation tank with excess glucose was followed by an anoxic production tank of limiting glucose fed by simultaneous saccharification and fermentation of a corn mash. During the production phase changes in gene expression are modest in number. A set of candidate promoters were identified and a means to test these candidates was developed. The "transcript off changes" were also tabulated with the most dramatic differences being off by at least 10 fold. The shut off of Fe and Zn genes may suggest that the medium has excess divalent metal ions while the induction of MAL1 genes indicates both glucose limitation and maltose availability.

Fermentation

Biological triplicate cultures were performed at all steps. A CEN.PK gpd2-pdc-yeast strain (PNY1504, described in US Appn. Pub. No. 20120237988, incorporated herein by reference) was grown in 3 g/L glucose+3 g/L ethanol salt medium for ~24 hrs. 13-15 mL of each 250 mL culture was transferred to ~270 mL medium in a 2 L, baffled, vented flask at an OD 2.0-2.5. Four 2 L flasks were started for each propagation tank. 24 hrs after inoculating the 2 L flasks. Subsequently, 30 mL of YEP stock solution (200 g/L peptone, 100 g/L yeast extract) was added to each flask, then 300 mL of sterile, virgin, 90-95% Cognis oleyl alcohol was added and the flasks were returned to the shaker for ~20 hrs. The aqueous phase and oleyl alcohol phase were allowed to settle for ~5 minutes. The aqueous phase was pooled together from all 12 flasks and ~1.2 L was distributed to three pressure cans that were used to inoculate each propagation tank. The glucose concentration in the media was allowed to drop from ~1-2 g/L at inoculation to <0.5 g/L and a 50% w/w glucose feed was started with a rate of ~m=0.17 until OD>25. Thereafter, the concentration of dissolved oxygen was maintained at 30%. Approximately 1.1 L of propagation tank culture was then transferred to its corresponding production tank. Simultaneous Saccharification and Fermentation (SSF) were carried out using a glucoamylase (β-amylase), maintaining an excess of glucose and a low concentration of dissolved oxygen (3%) for the entire production stage. The triplicate cultures were designated as follows:

GLNOR714PROP→GLNOR715FERM
GLNOR716PROP→GLNOR717FERM
GLNOR718PROP→GLNOR719FERM

Molecular Biology

RNA was isolated from propagation and production tanks by standard methods. RNA species were quantified using Agilent arrays by standard methods. Data was averaged and statistical analysis was performed. The abundance of RNA transcripts were interpreted with regard to physiology. Hence, relevant physiological data is summarized for the propagation tank first.

Physiology

Figure 2:
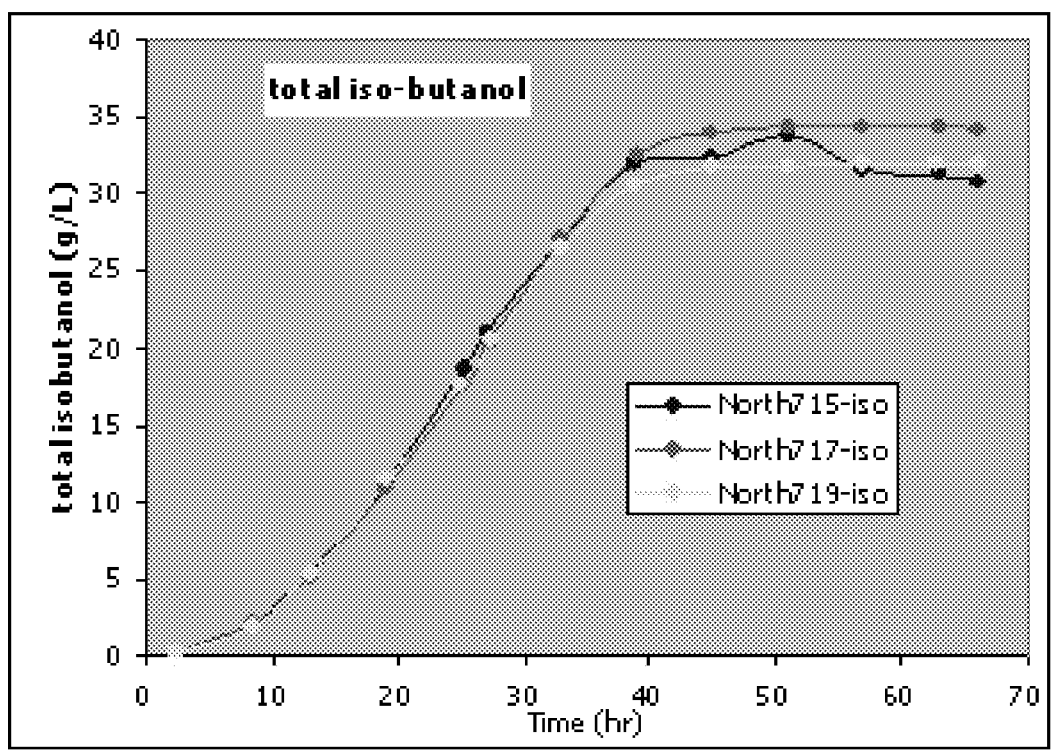
FIG. 2 depicts that isobutanol is synthesized at 26 and 37 hrs and that by 50 hrs of cell culture, isobutanol accumulation ceases.
Figure 3:
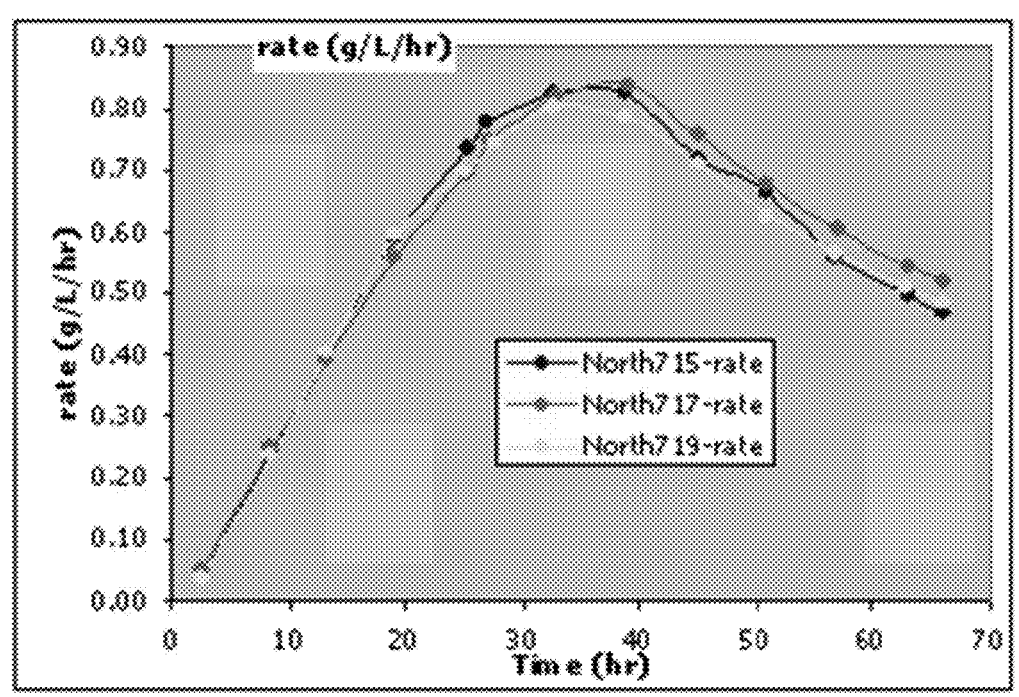
FIG. 3 depicts rate of isobutanol production, in g/L/hr, over fermentation time.
Figure 4:
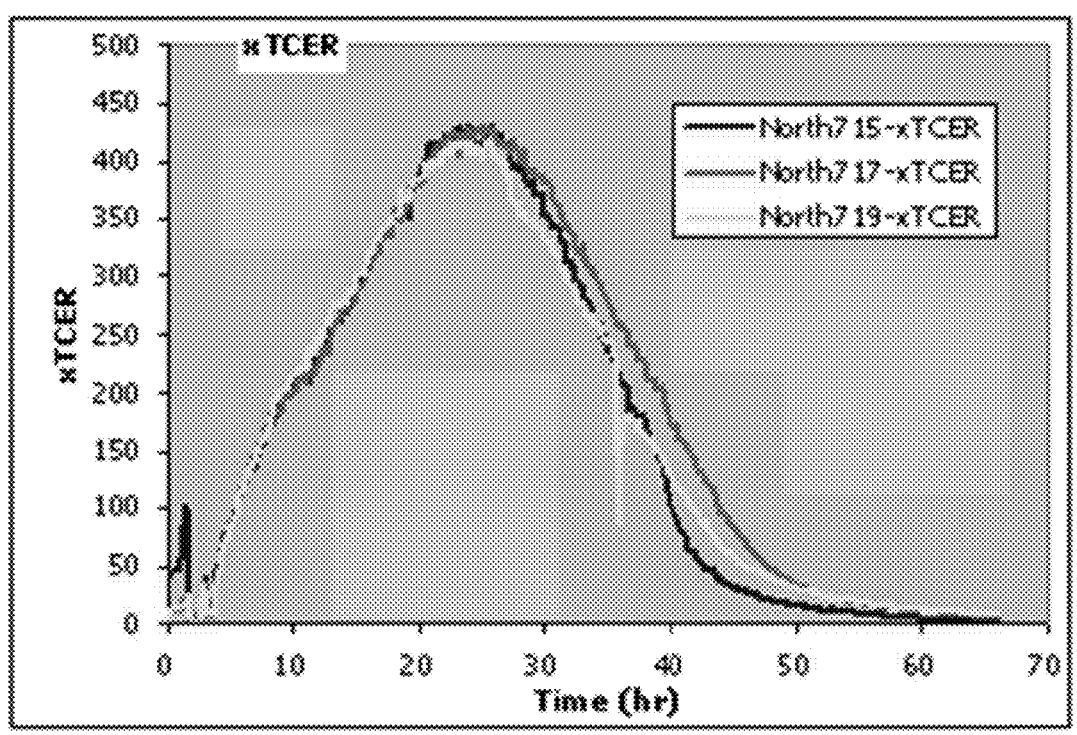
FIG. 4 depicts carbon dioxide evolution rate over fermentation time.
Figure 5:
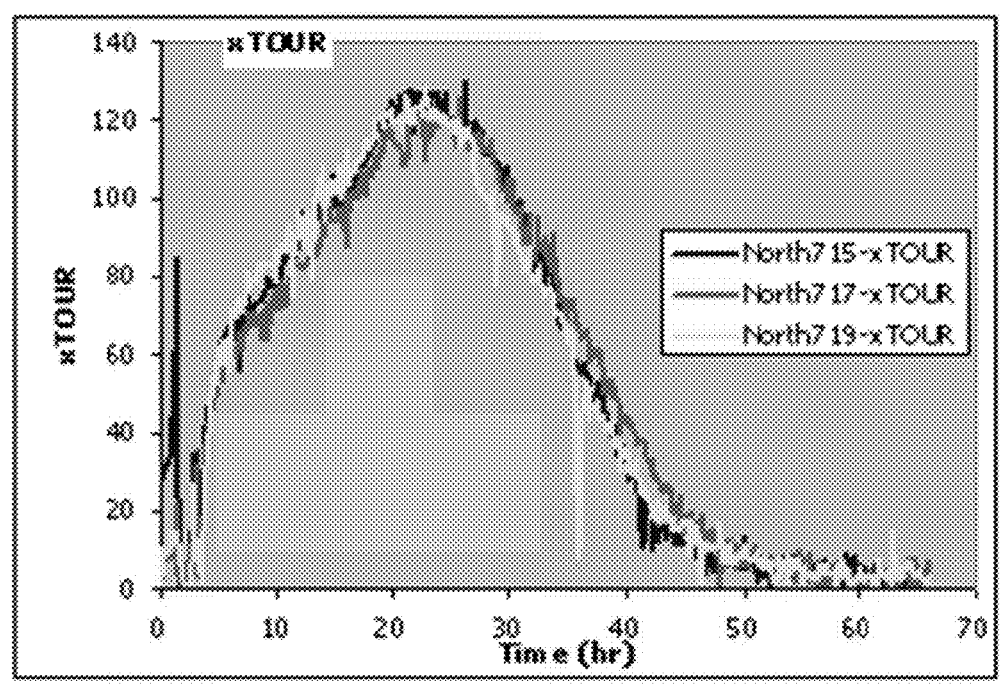
FIG. 5 depicts oxygen consumption over fermentation time.

In fermentation tanks, it was observed that at 26 and 37 hrs, isobutanol is being synthesized. However, by 50 hrs isobutanol accumulation ceases. See FIG. 2. Note however, that cumulative rate data (volumetric isobutanol produced/EFT) is misleading in that the catalyst is not performing optimally until about 40 hrs of culture. See FIG. 3. This was verified by studying the carbon dioxide evolution and oxygen consumption rates, which both decline precipitously after 30 hrs and are close to zero at 50 hrs. See FIGS. 4 and 5. Thus, the 26, 37, and 50 hr transcript measures were chosen are most relevant for the purposes of this promoter prospecting experiment.

All promoter elements that are significantly up or down regulated in the production tank are summarized in the following table:

TABLE 7

| Name | Expression Range | EFT (hr) 26 | 37 | 50 |
|---|---|---|---|---|
| Up | >1.5x | 129 | 62 | 312 |
| Down | <0.5x | 44 | 29 | 108 |

Thus, although relatively few transcripts appreciably changed between the propagation and production stages, there are numerous candidate promoters.

In these experiments, the aim was to identify RNAs that are regulated by the anoxic conditions of the fermentation tank. The promoters of such RNAs could be useful switches (e.g., OFF→ON) or amplifier modules (e.g., LOW→HIGH) that elevate expression from a significant basal level. Both "switch" and "amplifier" promoter elements are desirable.

Two ORFs (YJL171C and YGR287C) were transcribed at 26 hrs and retained elevated expression levels while DIA1 was transcribed at 37 hrs and was still highly expressed at 50 hrs. There are also choices to throw a switch at 26 hrs (IMD2), 37 hrs (CHA1 and YJL195C) and 50 hrs (PRM6).

Initially, the top 45 transcripts were categorized under each of the four conditions in the following table:

TABLE 8

| | | # in Top 45 Tank | | | |
|---|---|---|---|---|---|
| | | Prop | Production | | |
| | | | hr | | |
| | | 15 | 26 | 37 | 50 |
| Category | fueling | 16 | 16 | 16 | 13 |
| | translation | 9 | 18 | 8 | 3 |
| | aa | 4 | 3 | 3 | 3 |
| | stress | 7 | 3 | 11 | 16 |
| | metals | 1 | 0 | 0 | 0 |

From the propagation tank, 37 of the top 45 transcripts fall into the listed categories. In the production tank, the fraction is 40/45, 38/45, and 35/45 at 26, 37 and 50 hr EFT, respectively. As expected, translation is critical during exponential growth (26 hrs/production) but not to the other three conditions (15 hr, 37 hr, and 50 hr) which are more akin to stationary phase.

Example 3 (Prophetic)

Controlling Expression of alsS (Encoding Acetolactate Synthase) in Isobutanologen Yeast Using a Genetic Switch The promoter of the *Saccharomyces cerevisiae* IMA1 gene (YGR287C) is selected for evaluation as a genetic switch. The DNA comprising this promoter, 1000 base pairs 5' of the IMA1 start codon, is amplified using primers AK11-62 and AK11-63 (Table 10), which include recognition sites for the restriction enzymes XbaI and SalI, respectively, at their 5' ends. The template DNA is genomic DNA of yeast strain CEN.PK113-7D is purified (van Dijken J P, et al. (2000) "An interlaboratory comparison of physiological and genetic properties of four *Saccharomyces cerevisiae* strains" *Enzyme Microb. Technol.* 26:706-714.). Concurrently, a loxP-kanMX-loxP cassette, which includes the selectable marker for geneticin resistance and which is flanked by the loxP sequences that are targets of the cre site-specific recombinase, is amplified using primers AK11-60 and AK11-61 (which include recognition sites for the restriction enzymes BamHI and XbaI, respectively, at their 5' ends), using as template the cassette cloned into plasmid pUC19. The PCR reactions produce the expected 1.0 and 1.8 kb DNA products, as demonstrated by agarose gel electrophoresis (not shown), and the products are purified.

TABLE 9

Oligonucleotides for Example 3

| Primer | SEQ ID NO: | Sequence |
|---|---|---|
| AK11-52 | 733 | CCAGACAAGAAGTTGCCGACAGTCTGTTGAATTGGCCT GGTTAGGCTTAAAACTCGTTGTATCATCACTGG |
| AK11-55 | 734 | CCTCTGTTTTTCACAAGGGATTTTTGTTCTTTTGTTGC TTTTGTCAACATTATTTCGATAGTAAATATTACGTTGA AAAG |
| AK11-56 | 735 | TGCTCACATCGTTTCGTCTGC |
| AK11-57 | 736 | GCTATGATTGACCCAGTGTTC |
| AK11-58 | 737 | CCCACGCTATAAATTGGCTAC |
| AK11-59 | 738 | TCCTGATGTGACTAACACGAC |
| AK11-60 | 739 | CTTGGATCCAACTCGTTGTATCATCACTGG |
| AK11-61 | 740 | TCATCTAGAGATTACGTATTCTAATGTTCAG |
| AK11-62 | 741 | TCATCTAGAGGAACGGGGCTGTATGTTTATG |
| AK11-63 | 742 | CTTGTCGACTATTTCGATAGTAAATATTACGTTGAAAAG |

Oligonucleotides used in this example. Underlined bases are restriction endonuclease recognition sites (see text), and dashed underlined bases are regions of homology to a genomic target locus.

Figure 6:
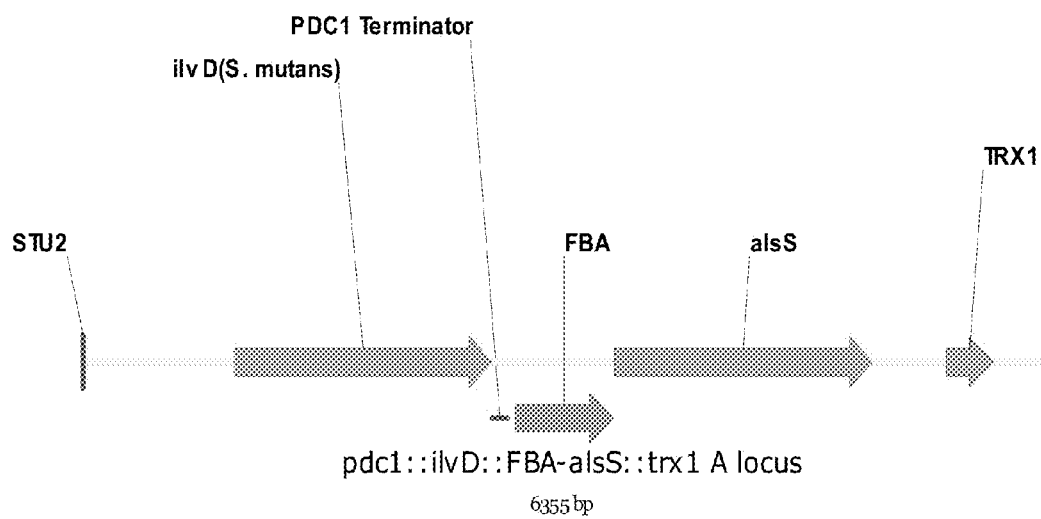
FIG. 6 depicts a map of the genetic elements in chromosome XII of strain PNY1556, showing the FBA1 promoter that drives expression of alsS, and the PDC1 terminator immediately upstream.

The IMA1 promoter DNA is digested with the restriction enzymes XbaI and SalI, and the loxP-kanMX-loxP DNA is digested with the restriction enzymes BamHI and XbaI; concurrently, plasmid pUC19 DNA is digested with BamHI and SalI. The digested DNAs are combined and ligated then transformed into chemically competent *E. coli* cells and plated onto LB agar (10 g/L tryptone, 5 g/L yeast extract, 10 g/L NaCl, 15 g/L agar) containing 100 μg/ml ampicillin. Individual colonies are checked by restriction mapping for constructs in which the loxP-kanMX-loxP cassette has been ligated upstream of the IMA1 promoter. One such construct is named pNAK21. It is used as template in a PCR reaction with primers AK11-52 and AK11-55. These primers include regions of homology to the sequences of the PDC1 terminator and the 5' end of the alsS open reading frame, respectively (and the AK11-55 primer also changes the bases preceding the alsS start codon from TGAGG to AAATA). The genetic map of the region surrounding the alsS transgene in strain PNY1556 is shown in FIG. 6.

The PCR reaction is performed, the 2.8 kb product is purified, and transformed into yeast strain PNY1556 (genotype MATa ura3Δ::loxP his3Δ pdc6Δ pdc1Δ::P[PDC1]-DHAD|ilvD_Sm-PDC1t-P[FBA1]-ALS|alsS_Bs-CYC1t pdc5Δ::P[PDC5]-ADH|sadB_Ax-PDC5t gpd2Δ::loxP fra2Δ::P[PDC1]-ADH|adh_HI-ADH1t adh1Δ::UAS(PGK1)P[FBA1]-kivD_Lg(y)-ADH1t yprcΔ15Δ::P[PDC5]-ADH|adh_HI-ADH1t) essentially as described ("Yeast transformation by the LiAc/SS Carrier DNA/PEG method" Gietz RD & Woods R A (2006) Methods Mol Biol 313:107-120) except that the cells are grown in YPE medium (5 g/L yeast extract, 10 g/L peptone, 20 mL/L 95% ethanol). Transformed cells are plated onto YPE agar medium containing 200 pg/ml G418 (MP Biomedicals). Colonies are re-streaked onto the same medium, and tested for replacement of the FBA1 promoter with the IMA1 promoter in front of the alsS transgene by PCR, using primers AK11-56 and AK11-57 in one set of reactions, and primers AK11-58 and AK11-59 in another set of reactions. The PCR reactions are carried with colony lysates as template. One isolate, named PNY942 that generates PCR products of 510 bp and 550 bp respectively with the two primer pairs, is chosen for further use.

PNY942 is transformed with plasmid pSH47, which bears the cre recombinase ORF under control of a galactose-inducible promoter ("A new efficient gene disruption cassette for repeated use in budding yeast" Guldener U, Heck S, Fielder T, Beinhauer J, & Hegemann J H (1996) *Nucleic Acids Res* 24:2519-2524) and selected for uracil prototrophy. Isolates are grown in SCG medium (6.7 g/L yeast nitrogen base without amino acids (Becton, Dickinson and Co.), yeast amino acid dropout mix minus uracil (Formedium DSCK102), and 20 g/L galactose) for approximately 6 h, then diluted and spread onto YPD plates and incubated for 3 d at 30° C. Colonies are replica-plated onto YPD plates containing 200 μg/mL G418; isolates that do not grow have lost the kanMX marker.

Figure 7:
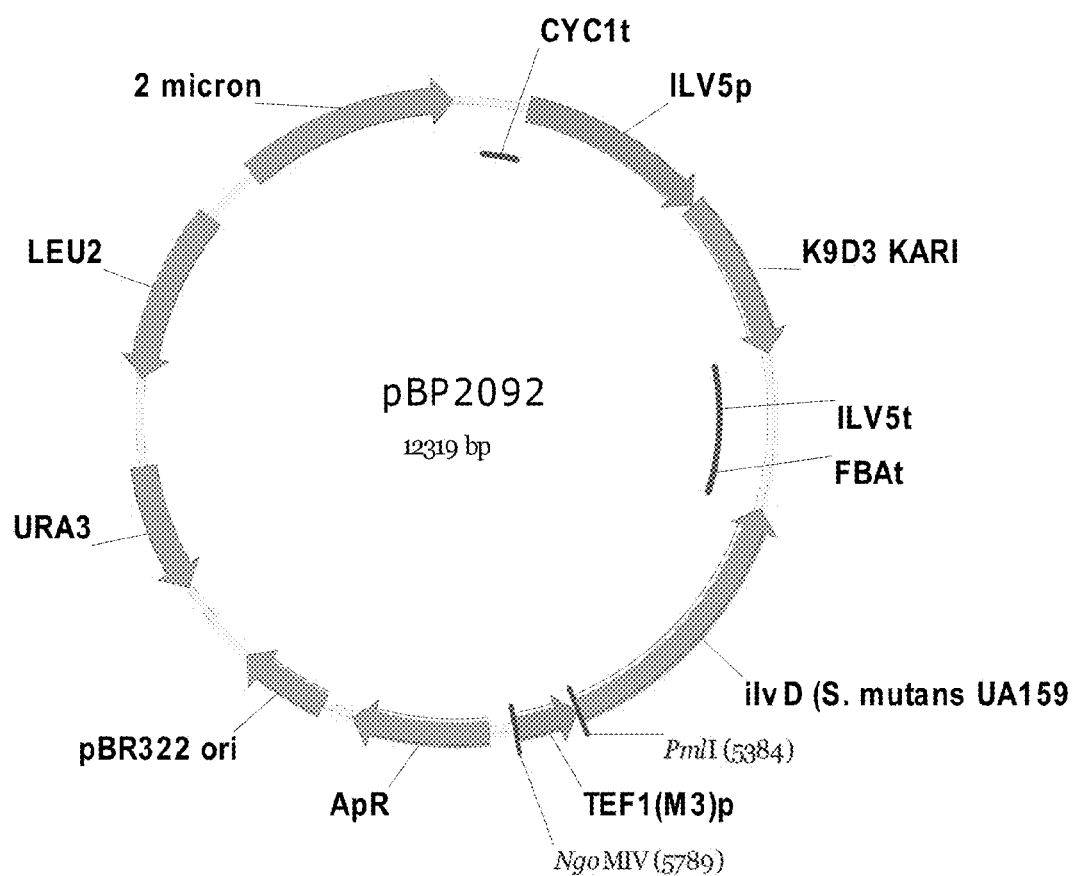
FIG. 7 depicts plasmid pBP2092, a yeast-E. coli shuttle vector carrying transgenes for KARI and DHAD with regulatory sequences for their expression in yeast.

Three of these G418-sensitive derivatives of PNY942 are transformed with plasmid pBP2092, which contains KARI and DHAD transgenes (FIG. 7).

Transformants are plated onto SCE agar medium (6.7 g/L yeast nitrogen base without amino acids, yeast amino acid dropout mix minus histidine and uracil (Formedium DSCK162), 20 mL/L 95% ethanol, 20 g/L agar) and grown at 30° C. for 3 d. Twelve colonies are re-streaked onto SCDE plates (6.7 g/L yeast nitrogen base without amino acids, yeast amino acid dropout mix minus histidine and uracil (Formedium DSCK162), 3 g/L glucose, 3 mL/L 95% ethanol, 20 g/L agar).

Three representative isolates are inoculated into 2 mL liquid SCDE cultures (Stage 0). The cultures are grown, and samples are withdrawn for biomass and extracellular metabolite determination. The remainder of each culture is centrifuged, and resuspended in 25 mL corn mash medium in a 125 mL flask (sealed caps). The corn mash for simultaneous saccharification and fermentation is prepared essentially as described (Wang F Q, Gao C J, Yang C Y, & Xu P (2007) "Optimization of an ethanol production medium in very high gravity fermentation" *Biotechnol Lett.* 29:233-236) and clarified by centrifugation. Oleyl alcohol (25 mL) is added to each flask, and the flasks are incubated at 250 rpm and 30° C. for 72 h (Stage 2). Samples are withdrawn for biomass and extracellular metabolite determination. The unmodified PNY1556 strain (transformed with pBP2092) is cultivated in parallel as a control.

The biomass concentrations in the samples are determined as optical density ($OD_{600}$) of an appropriately diluted suspension in a Genesys 10uv spectrophotometer (Thermo). The extracellular metabolites (glucose, isobutanol, and glycerol) are determined using a Waters 2695 HPLC with a Phenomenex Rezex ROA-Organic Acid H+ (8%) column, with 0.1 N $H_2SO_4$ as mobile phase (50° C., flow rate, 0.5 mL/min), with analyte detection by a Waters 2414 refractive index detector.

Prophetic results for this experiment are shown in Table 10. Strain PNY942 produces much more biomass and less isobutanol in Stage 1 than strain PNY1556. In Stage 2, when the IMA1 promoter is induced by the oligosaccharides in the corn mash, the isobutanol pathway is fully expressed and the PNY942 strain is able to produce an amount of isobutanol comparable to that produced by strain PNY1556. The glucose consumption capacities of the two strains are similar too (neither leave residual glucose in the Stage 1 or Stage 2 culture media); in the PNY942 strain, that glucose is directed primarily into biomass in Stage 1 because the IMA1 promoter is uninduced in the glucose-containing medium.

TABLE 10

Prophetic
Prophetic biomass and metabolite concentrations from growth and fermentation stages of isobutanol shake-flask production cultures.

|  | Stage 1 | | Stage 2 | |
| --- | --- | --- | --- | --- |
|  | PNY1556 | PNY942 | PNY1556 | PNY942 |
| Biomass | Low | High | Low | High |
| Glucose | Zero | Zero | Zero | Zero |
| Isobutanol | Medium | Low | High | High |

Example 4 (Prophetic)

Controlling Expression of alsS (Encoding Acetolactate Synthase) in Isobutanologen Yeast Using a Heterologous Genetic Switch In order to make alsS expression repressible by tetracycline, the host strain needs to express the tTA activator protein, and the alsS ORF needs to be placed under control of a tetO promoter (Bellí G, Garí E, Aldea M, & Herrero E (1998) "Functional analysis of yeast essential genes using a promoter-substitution cassette and the tetracycline-regulatable dual expression system" *Yeast* 14:1127-1138).

A cassette comprising the tTA minigene (including the CMV promoter) and the kanMX selectable marker (flanked by loxP sites) from pUG6-tTA (Yen K, Gitsham P, Wishart J, Oliver S G, & Zhang N (2003) "An improved tetO promoter replacement system for regulating the expression of yeast genes" *Yeast* 20:1255-1262.) is amplified using primers otTA1 and otTA2, which introduce NoI sites at either end of the minigene; amplification is performed. The 3.5 kb PCR product is cloned into pBluescript SK+ at the unique NoI site, resulting in plasmid pBS-tTA. The kanMX4-TetO7 promoter cassette is amplified from plasmid pCM325 (ibid.) using primers oTetO1 and oTetO2, which introduce BamHI sites at either end of the cassette. The 2.2 kb PCR product is cloned into pUC19 at the unique BamHI site, resulting in plasmid pUC-TetO.

TABLE 11

Oligonucleotides for Example 4

Oligonucleotides used in this example. Underlined bases are restriction endonuclease recognition sites (see text), and dashed underlined bases are regions of homology to a genomic target locus.

| Primer | SEQ ID NO: | Sequence |
|---|---|---|
| otTA1 | 780 | AACGCGGCCGCCAGCTGAAGCTTCGTACGC |
| otTA2 | 781 | TCCGCGGCCGCATAGGCCACTAGTGGATCTG |
| oTetO1 | 782 | GACGGATCCCCGGGTTAATTAAGGCGCGCC |
| oTetO2 | 783 | AACGGATCCCCCGAATTGATCCGGTAATTTAG |
| otTA3 | 784 | TTCCGGTTTCCTTGAAATTTTTTTGATTCGGTAATCTCCGAGCAGAAGGACAGCTGAAGCTTCGTACGC |
| otTA4 | 785 | CAAATTAGAGCTTCAATTTAATTATATCAGTTATTACCCGGGAATCTCGGATAGGCCACTAGTGGATCTG |
| oTetO3 | 786 | CCAGACAAGAAGTTGCCGACAGTCTGTTGAATTGGCCTGGTTAGGCTTAACCGGGTTAATTAAGGCGCGCC |
| oTetO4 | 787 | CCTCTGTTTTTCACAAGGGATTTTTGTTCTTTTGTTGCTTTTGTCAACATTATTCCCGAATTGATCCGGTAATTTAG |
| oTetO5 | 788 | GGCATGCATGTGCTCTGTATG |

The tTA minigene in pBS-tTA is amplified with primers otTA3 and otTA4, which include regions of flanking homology for recombination at the URA3 locus. The PCR product is used to transform strain PNY1556 with selection for resistance to G418. Antibiotic-resistant isolates are transformed with plasmid pSH47, which bears the cre recombinase ORF under control of a galactose-inducible promoter (Guldener U, Heck S, Fielder T, Beinhauer J, & Hegemann J H (1996) "A new efficient gene disruption cassette for repeated use in budding yeast" *Nucleic Acids Res* 24:2519-2524) and selected for uracil prototrophy. Isolates are grown in SCG medium (6.7 g/L yeast nitrogen base without amino acids, yeast amino acid dropout mix minus uracil (Formedium DSCK102), and 20 g/L galactose), then diluted and spread onto YPD plates. Colonies are replica-plated onto YPD plates containing 200 µg/mL G418; isolates that do not grow have lost the kanMX marker.

The kanMX4-TetO7 cassette in pUC-TetO is amplified with primers oTetO3 and oTetO4, which include regions of homology to the sequences of the PDC1 terminator and the 5' end of the alsS open reading frame, respectively (and the oTetO4 primer also changes the bases preceding the alsS start codon from TGAGG to AAATA). The PCR reaction is performed; the product is purified using a PCR Purification kit; and transformed into yeast strain PNY1556 as described (Gietz R D & Woods R A (2006) "Yeast transformation by the LiAc/SS Carrier DNA/PEG method" *Methods Mol. Biol.* 313:107-120) except that the cells are grown in YPE medium (5 g/L yeast extract, 10 g/L peptone, 20 mL/L 95% ethanol). Transformed cells are plated onto YPE agar medium containing 200 µg/ml G418 and 10 µg/mL doxycycline (to maintain the TetO7 promoter in a repressed state). Colonies are re-streaked onto the same medium and tested for replacement of the FBA1 promoter with the TetO7 promoter in front of the alsS transgene by PCR, using primers AK11-59 and oTetO5. The PCR reactions are carried with colony lysates as template (openwetware.org/wiki/Blackburn:Yeast_Colony_PCR_v2.0 17 Nov. 2011). One isolate, named PNY943 that generates a PCR product of 420 bp is chosen for further use.

PNY943 is transformed with plasmid pBP2092 as described in Example 5. Transformants are plated onto SCE agar medium+10 µg/mL doxycycline. Twelve colonies are re-streaked onto SCDE plates+10 µg/mL doxycycline.

After 3 d of growth on plates, 3 representative isolates are inoculated into 2 mL liquid SCDE cultures+10 µg/mL doxycycline (Stage 0). These are grown, and pitched into a shake flask containing 25 mL of SCDE medium+10 µg/mL doxycycline. The cultures are grown for 24 h at 30° C. (Stage 1), and samples are withdrawn for biomass and extracellular metabolite determination. The remainder of each culture is centrifuged at 1864 g in an F15-8x50c Fiberlite rotor (Piramoon Technologies), and resuspended in 25 mL corn mash medium in a 125 mL flask (sealed cap). Oleyl alcohol (25 mL) is added to each flask, and the flasks are incubated at 250 rpm and 30° C. for 72 h (Stage 2). Samples are withdrawn for biomass and extracellular metabolite determination as described in example A. The unmodified PNY1556 strain (transformed with pBP2092) is cultivated in parallel as a control.

Prophetic results for this experiment are shown in Table 12. Strain PNY943 produces much more biomass and less isobutanol in Stage 1 than strain PNY1556, due to the repression of expression of alsS activity by doxycycline. In Stage 2, when the cells are grown in corn mash in the absence of doxycycline, the isobutanol pathway is fully expressed and the PNY943 strain is able to produce an amount of isobutanol comparable to that produced by strain PNY1556. The glucose consumption capacities of the two strains are similar too (neither leave residual glucose in the Stage 1 or Stage 2 culture media).

TABLE 12

Prophetic
Prophetic biomass and metabolite concentrations from growth and
fermentation stages of isobutanol shake-flask production cultures.

|  | Stage 1 | | Stage 2 | |
| --- | --- | --- | --- | --- |
|  | PNY1556 | PNY943 | PNY1556 | PNY943 |
| Biomass | Low | High | Low | High |
| Glucose | Zero | Zero | Zero | Zero |
| Isobutanol | Medium | Low | High | High |

Example 5

Expression of ALS in PNY1560, PNY1561, and PNY1562 with and without Glucose

This example demonstrates the level of ALS expression in the glucose-responsive strains PNY1560 and PNY1561 and the control strain PNY1562 in the presence or absence of glucose. Acetate was used as the carbon source for growth in the absence of glucose. Both mRNA levels and ALS enzyme activity were assayed.

For the measurement of mRNA levels, strains were first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, 0.3% glucose, and 0.1% sodium acetate. Overnight cultures were grown in 34 mL of medium in 250 mL vented Erlenmeyer flasks at 30° C., 250 RPM in a New Brunswick Scientific I24 shaker. Overnight cultures were then sub-cultured into acetate synthetic medium (Yeast Nitrogen Base without Amino Acids and Yeast Synthetic Drop-Out Media Supplement without uracil, histidine, leucine, and tryptophan supplemented with 76 mg/L tryptophan, 380 mg/L leucine, 100 mM MES pH5.5, and 0.5% sodium acetate) and glucose synthetic medium (Yeast Nitrogen Base without Amino Acids and Yeast Synthetic Drop-Out Media Supplement without uracil, histidine, leucine, and tryptophan supplemented with 76 mg/L tryptophan, 380 mg/L leucine, 100 mM MES pH5.5, and 3% glucose) to an initial OD600 0.1 in 20 ml of medium in 125 ml vented Erlenmeyer flasks. The acetate cultures were grown for 6.5 hours at 30° C., 250 RPM in a New Brunswick Scientific I24 shaker, sub-cultured back to an OD600 0.1 in 20 ml of the same medium, and grown for 16 hours under the same conditions. The acetate cultures were then sub-cultured back to an OD600 0.5 in 20 ml of the same medium and grown for 4 hours under the same conditions prior to harvesting the cells. The glucose cultures were grown for 6.5 hours at 30° C., 250 RPM in a New Brunswick Scientific I24 shaker, sub-cultured back to an OD600 0.2 in 20 ml of the same medium, and grown for 16 hours under the same condition. The glucose cultures were centrifuged at 4,000×g for 5 minutes at room temperature and resuspended in fresh glucose medium to an OD600 0.25. 20 ml of culture was transferred to a 125 ml vented Erlenmeyer flask for aerobic conditions and 10 ml of culture was transferred to a 40 ml serum vial (Kimble Chase, Vineland, N.J.) and sealed for microaerobic conditions. The glucose cultures were then grown for 24 hours under the same conditions prior to harvesting the cells.

After cell growth, the cultures were harvested and RNA extracted. For cell harvest, 10 ml of culture was added to an ice cold 15 ml conical tube and was centrifuged at 4,000×g for 4 minutes at 4° C. Pellets were immediately resuspended in 1 ml of Trizol (Invitrogen, Carlsbad, Calif.), frozen on dry ice and then stored at −80° C. until RNA extraction. For RNA extraction, samples were thawed on ice and transferred to 2 ml screw cap tubes containing Lysing Matrix B 0.1 mm silica spheres (MP Biomedicals, Solon, Ohio). The samples were subjected to a bead beater two times at maximum speed for one minute. 200 μl of chloroform was added and samples vortexed. The samples were centrifuged at 13,000×g for 15 minutes at 4° C. 600 μl of aqueous phase was added to 650 μl of 70% ethanol and mixed. The sample was applied to Qiagen RNeasy Kit (Qiagen, Valencia, Calif.) spin columns and the manufacturer's protocol was followed. RNA was eluted from the column with 50 μl RNase-free water. RNA samples were stored at −80° C. until real time reverse transcription PCR analysis.

Primer Design and Validation:

Prior to expression analysis, real time PCR primers and probes were designed using Primer Express v.2.0 software from ABI/Life Technologies under default conditions. Primers were purchased from Sigma-Genosys, Woodlands, Tex., 77380. Primers were validated for specificity using BLAST analysis and for quantitation by analyzing PCR efficiency across a dilution series of target DNA. Primer efficiencies were validated with efficiencies from 90%-110%. Primer sequences are shown in the table below.

TABLE 13

Primers

| Gene | Name | Function | Sequence | SEQ ID |
| --- | --- | --- | --- | --- |
| alsS | alsS-559F | Forward | GCTGTTGCAGCGCCAAA | 718 |
|  | alsS-618R | Reverse | TGCTATGGCCGCACTGATT | 719 |
|  | alsS-577T | Probe | 6FAM-CTCGGTCCTGCAGCAGATGATG-TAMRA | 720 |
| 18S rRNA | 18S-396F | Forward | AGAAACGGCTACCACATCCAA | 721 |
|  | 18S-468R | Reverse | TCACTACCTCCCTGAATTAGGATTG | 722 |
|  | 18S-420T | Probe | 6FAM-AAGGCAGCAGGCGCGCAAATT-TAMRA | 723 |
| HXT1 | HXT1-1586F | Forward | CCGAAGGTGTTCTACCATGGA | 724 |
|  | HXT1-1647R | Reverse | GTCAGCGCCTCTCTTGGATACT | 725 |
|  | HXT1-1610T | Probe | 6FAM-CAGCTTCCTGGGTTC-TAMRA | 726 |
| HXT3 | HXT3-744F | Forward | TGGTATGACTTTCGTTCCAGAATC | 727 |
|  | HXT3-814R | Reverse | ATGCTCTTGCTTCGTCAATTTG | 728 |
|  | HXT3-769T | Probe | 6FAM-CCACGTTATTTGGTTGAAGCTGG-TAMRA | 729 |

TABLE 13-continued

Primers

| Gene | Name | Function | Sequence | SEQ ID |
|---|---|---|---|---|
| TEF1 | tef1-739F | Forward | CCATTGCAAGATGTTTACAAGATTG | 730 |
|  | tef1-811R | Reverse | TGATGACACCGGTTTCAACTCT | 731 |
|  | tef1-765T | Probe | 6FAM-TGGTATTGGTACTGTGCCAGTCG-TAMRA | 732 |

Real Time Reverse Transcription PCR:

2 ug of purified total RNA was treated with DNase (Qiagen PN79254) for 15 min at room temperature followed by inactivation for 5 min at 75 C in the presence of 0.1 mM EDTA. A two-step RT-PCR was then performed using 1 ug of treated RNA. In the first step RNA was converted to cDNA using the High Capacity cDNA Reverse Transcription Kit from ABI/Life Technologies (PN 4368813) according to the manufacturer's recommended protocol. The second step in the procedure was the qPCR or Real Time PCR. This was carried out on an ABI 7900HT SDS instrument. Each 20 ul qPCR reaction contained 1 ng cDNA, 0.2 ul of 100 uM forward and reverse primers, 0.05 ul TaqMan probe, 10 ul TaqMan Universal PCR Master Mix (AppliedBiosystems PN 4326614) and 8.55 ul of water. Reactions were thermal cycled while fluorescence data was collected as follows: 10 min. at 95 C followed by 40 cycles of 95 C for 15 sec and 60 C for 1 minute. A (−) reverse transcriptase RNA control of each sample was run with the 18S rRNA primer set to confirm the absence of genomic DNA. All reactions were run in triplicate.

Relative Expression Calculations:

The relative quantitation of the target gene alsS in the samples was calculated using the ΔΔCt method (see ABI User Bulletin #2 "Relative Quantitation of Gene Expression"). 18S rRNA was used to normalize the quantitation of the target gene for differences in the amount of total RNA added to each reaction. The relative quantitation (RQ) value is the fold difference in expression of the target genes in each sample relative to the calibrator sample which has an expression level of 1.0.

The amount of alsS transcript from the PNY1562 acetate culture was set at 1.0. The PNY1560 and PNY1561 alsS transcript levels from the acetate grown cultures were 167-fold and 500-fold, respectively, lower than the PNY1562 alsS transcript level from the acetate grown culture. The PNY1562 alsS transcript level was not higher in the glucose grown cultures compared to the PNY1562 acetate grown culture. The PNY1560 alsS transcript level was 12- to 34-fold higher in the glucose grown cultures compared to the PNY1560 acetate grown culture. The PNY1561 alsS transcript level was 10- to 19-fold higher in the glucose grown cultures compared to the PNY1561 acetate grown culture.

TABLE 14

Relative alsS mRNA expression levels.

| Strain | Acetate Medium | Glucose Medium - aerobic | Glucose Medium - microaerobic |
|---|---|---|---|
| PNY1562 | 1.000 | 1.000 | 0.538 |
| PNY1560 | 0.006 | 0.206 | 0.075 |
| PNY1561 | 0.002 | 0.019 | 0.038 |

For ALS enzyme assay experiment 1, strains were first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, 0.3% glucose, and 0.1% sodium acetate. Overnight cultures were grown in 40 mL of medium in 250 mL vented Erlenmeyer flasks at 30° C., 250 RPM in a New Brunswick Scientific I24 shaker. Overnight cultures were then sub-cultured into acetate synthetic medium (Yeast Nitrogen Base without Amino Acids and Yeast Synthetic Drop-Out Media Supplement without uracil, histidine, leucine, and tryptophan supplemented with 76 mg/L tryptophan, 380 mg/L leucine, 100 mM MES pH5.5, and 0.5% sodium acetate) and glucose synthetic medium (Yeast Nitrogen Base without Amino Acids and Yeast Synthetic Drop-Out Media Supplement without uracil, histidine, leucine, and tryptophan supplemented with 76 mg/L tryptophan, 380 mg/L leucine, 100 mM MES pH5.5, and 3% glucose) to an initial OD600 0.1 in 40 ml of medium in 250 ml vented Erlenmeyer flasks. The cultures were grown for 7 hours at 30° C., 250 RPM in a New Brunswick Scientific I24 shaker, sub-cultured back to an OD600 0.2 in 40 ml of the same medium, and grown for 15 hours under the same conditions. The acetate cultures were then sub-cultured back to an OD600 1.0 in 40 ml of the same medium and grown for 7 hours under the same conditions prior to harvesting the cells. The glucose cultures were centrifuged at 4,000×g for 5 minutes at room temperature and resuspended in fresh glucose medium to an OD600 0.5. 60 ml of culture was transferred to a 120 ml serum vial (Kimble Chase, Vineland, N.J.) and sealed for microaerobic conditions. The glucose cultures were then grown for 24 hours at 30° C., 250 RPM in a New Brunswick Scientific I24 shaker prior to harvesting the cells. To harvest the cells, cultures were centrifuged at 4,000×g for 5 minutes at 4° C. Pellets were washed with 20 ml of 50 mM HEPES pH 6.8 and then centrifuged at 4,000×g for 5 minutes at 4° C. Pellets were frozen on dry ice and then stored at −80° C. until assayed for ALS activity.

For ALS enzyme assay experiment 2, a third growth condition was used. Strains were grown as above for the overnight culture and sub-cultured into the same acetate and glucose media. The cultures were grown for 7 hours at 30° C., 250 RPM in a New Brunswick Scientific I24 shaker, sub-cultured back to an OD600 0.1 in 40 ml of the same medium, and grown for 16 hours under the same conditions. The acetate cultures were then sub-cultured back to an OD600 1.0 in 40 ml of the same medium and grown for 4.5 hours under the same conditions prior to harvesting the cells. After the 16 hours of growth, the glucose cultures were centrifuged at 4,000×g for 5 minutes at room temperature and resuspended in fresh glucose medium to an OD600 0.5. 40 ml of culture was transferred to a 250 ml vented Erlenmeyer flask for aerobic conditions and 60 ml of culture was transferred to a 120 ml serum vial (Kimble Chase, Vineland, N.J.) and sealed for microaerobic conditions. The glucose cultures were then grown for 24 hours at 30° C., 250 RPM in a New Brunswick Scientific I24 shaker prior to harvesting the cells. To harvest the cells, cultures were centrifuged at 4,000×g for 5 minutes at 4° C. Pellets were washed with 20 ml of 50 mM HEPES pH 6.8 and then centrifuged at 4,000×g for 5 minutes at 4° C. Pellets were frozen on dry ice and then stored at −80° C. until assayed for ALS activity.

Frozen yeast cells were thawed, resuspended in 1.5 mL 0.1 M K-Hepes pH 6.8 containing 10 mM $MgCl_2$ and a protease inhibitor cocktail (Roche, Catalog #11873580001), and then broken by bead beating with 0.5 mm glass beads. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). ALS enzyme activities were measured spectrophotometrically in an end point assay using the method as described in W W Westerfeld (1945), J. Biol. Chem, 161, 495-502, with modifications.

The assay buffer contained 0.1 M K-Hepes pH 6.8, 10 mM $MgCl_2$, and 0.5 mM TPP. Sufficient sodium pyruvate was added to assay buffer so that the final concentration in the assay was 50 mM. In each assay, an enzyme containing solution and substrate containing buffer were mixed so that the final volume was 500 ul. Assay mixtures were incubated at 30 degree C. for 45 minutes. At fifteen minute intervals, a 100 ul aliquot of each reaction was mixed with 10 ul of a 6N of sulfuric acid in H2O. Following a 15 minute incubation at 60 C, 500 ul of 0.2% creatine in H2O and 500 ul 1.5% a-naphthol in 2.5N NaOH were added. After brief mixing, the samples were heated to 60 degrees C. for 15 minutes, cooled briefly, and the absorbance of the mixture was read at 530 nm with a Spectra Max384 Plus plate reader (Molecular Devices, Sunnyvale, Calif.). The slope of a standard curve for 0 to 0.63 mM acetoin, reaction rate (OD/min), and protein concentration (mg/mL) were used to calculate ALS specific activities (U/mg) of each sample.

ALS enzyme activity from PNY1560 and PNY1561 was higher for the cells grown in the glucose medium compared to the cells grown in the acetate medium (Tables 15 and 16).

TABLE 15

Experiment 1 - ALS enzyme activity (U/mg) for PNY1560, PNY1561, and PNY1562 grown in acetate or glucose

| Strain | ALS Activity in Acetate Medium | ALS Activity in Glucose Medium - microaerobic |
|---|---|---|
| PNY1560 | 0.00 | 0.46 |
| PNY1561 | 0.00 | 0.62 |
| PNY1562 | 3.27 | 1.29 |

TABLE 16

Experiment 2 - ALS enzyme activity (U/mg) for PNY1560, PNY1561, and PNY1562 grown in acetate or glucose

| Strain | ALS Activity in Acetate Medium | ALS Activity in Glucose Medium - aerobic | ALS Activity in Glucose Medium - microaerobic |
|---|---|---|---|
| PNY1560 | 0.04 | 0.31 | 0.06 |
| PNY1561 | 0.05 | 0.21 | 0.12 |
| PNY1562 | 3.43 | 1.09 | 5.54 |

Example 6

Glucose Induction of the PNY2289 alsS Transcript

This example demonstrates induction of the alsS transcript by the addition of glucose to 3% (final concentration) in the glucose-responsive strain PNY2289 for cells that had been grown under low glucose conditions. Polymer-based slow-release feed beads (Kuhner Shaker, Basel, Switzerland) were used for the low glucose condition.

PNY2289 was first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, and 0.5% ethanol. An overnight culture was grown in 50 mL of medium in a 250 mL vented Erlenmeyer flask at 30° C., 250 RPM in a New Brunswick Scientific I24 shaker. The overnight culture was centrifuged at 4,000×g for 5 minutes at room temperature, washed in the above medium without ethanol, and recentrifuged. The cell pellet was resuspended in the above medium without ethanol. Two 500 ml vented flasks containing the above medium without ethanol were inoculated to an OD600 0.13 with a final volume of 80 ml. One 12 mm Kuhner Shaker FeedBead Glucose disc was added to each flask and the cultures were grown at 30° C., 250 RPM in a New Brunswick Scientific I24 shaker. After a second and third feed bead was added at 6 and 10 hours post-inoculation, the cultures were continued for an additional 15 hours. After the 15 hours of growth, the concentration of glucose as measured by a YSI 7100 MBS glucose analyzer (YSI Life Sciences, Yellow Springs, Ohio) was less than 0.1 g/L. The cultures were then sub-cultured back to an OD600 0.5 in 80 ml of the above medium without ethanol in 500 ml vented Erlenmeyer flasks. 50% glucose was added to a final concentration of 3% and growth was continued at 30° C., 250 RPM. Cells were harvested just prior to the addition of glucose and at 2, 4, 6, 8, and 24 hours post-glucose addition to extract RNA.

At each time point, 10 ml of culture was added to an ice cold 15 ml conical tube and was centrifuged at 4,000×g for 4 minutes at 4° C. Pellets were immediately resuspended in 1 ml of Trizol (Invitrogen, Carlsbad, Calif.), frozen on dry ice and then stored at −80° C. until RNA extraction. For RNA extraction, samples were thawed on ice and transferred to 2 ml screw cap tubes containing Lysing Matrix B 0.1 mm silica spheres (MP Biomedicals, Solon, Ohio). The samples were subjected to a bead beater two times at maximum speed for one minute. 200 µl of chloroform was added and samples vortexed. The samples were centrifuged at 13,000×g for 15 minutes at 4° C. 600 µl of aqueous phase was added to 650 µl of 70% ethanol and mixed. The sample was applied to Qiagen RNeasy Kit (Qiagen, Valencia, Calif.) spin columns and the manufacturer's protocol was followed. RNA was eluted from the column with 50 µl RNase-free water. RNA samples were stored at −80° C. until real-time RT-PCR analysis.

Figure 9:
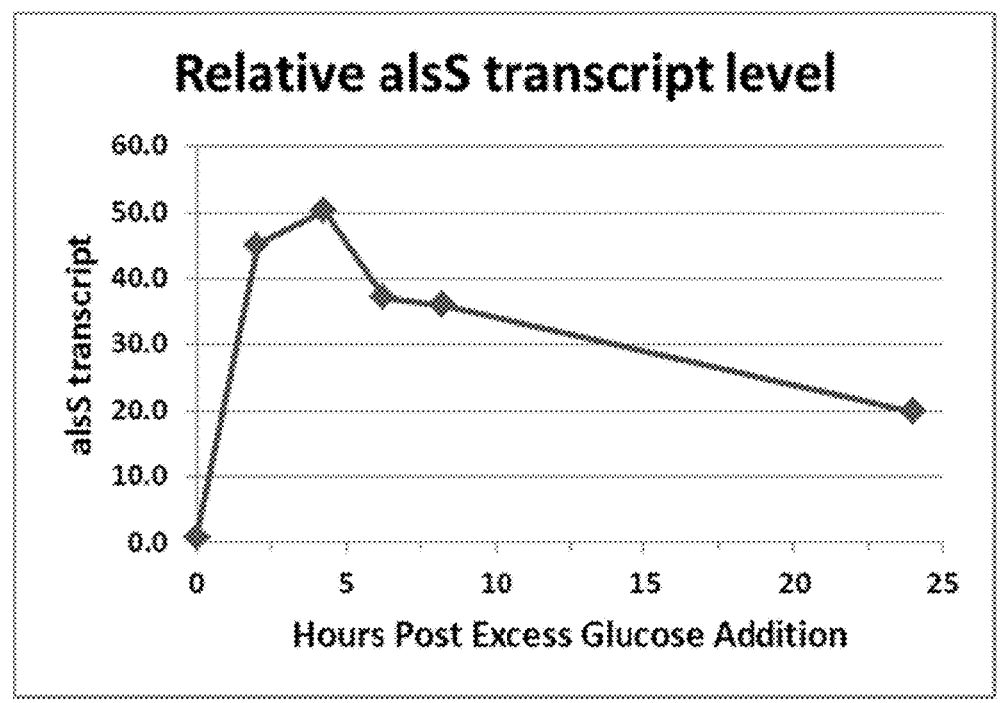
FIG. 9 shows induction of the alsS transcript in S. cerevisiae strain PNY2289 by glucose.

Real Time Reverse Transcription PCR analysis was carried out as above in example 5. Real-time RT-PCR data were normalized between samples using the 18S RNA transcript. The average alsS transcript levels for the two cultures, relative to the amount of transcript present prior to the addition of extra glucose, are represented in FIG. 9. The alsS transcript level in PNY2289 was induced approximately 50-fold when the cells were given a bolus of glucose, bringing the glucose concentration up to 30 g/L, after having been grown in a medium with less than 0.1 g/L of glucose.

Example 7

Isobutanol and Isobutyric Acid Production in PNY2289 and PNY1562 Grown in Low Glucose Conditions with and without a Pulse of Excess Glucose This example demonstrates the isobutanol and isobutyric acid profiles in the glucose-responsive strain PNY2289 and the control strain PNY1562 for cells that had been grown under low glucose conditions after they were or were not given a pulse of excess glucose. Isobutyraldehyde, the penultimate metabolite in the isobutanol pathway, may be reduced to isobutanol or oxidized to isobutyric acid. Both isobutanol and isobutyric acid were measured to determine the amount of flux through the isobutanol pathway, including ALS, the first step of the pathway. Polymer-based slow-release feed beads (Kuhner Shaker, Basel, Switzerland) were used for the low glucose condition.

PNY2289 and PNY1562 were first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, and 0.5% ethanol. An overnight culture was grown in 40 mL of medium in a 250 mL vented Erlenmeyer flask at 30° C., 250 RPM in a New Brunswick Scientific 124 shaker. The overnight cultures were centrifuged at 4,000×g for 5 minutes at room temperature, washed in the above medium without ethanol, and recentrifuged. The cell pellets were resuspended in the above medium without ethanol. Duplicate 500 ml vented flasks containing the above medium without ethanol were inoculated to an OD600 0.05 in a final volume of 80 ml for each strain. One 12 mm Kuhner Shaker FeedBead Glucose disc was added to each flask and the cultures were grown at 30° C., 250 RPM in a New Brunswick Scientific I24 shaker. After a second feed bead was added at 3 hours post-inoculation, the cultures were continued for an additional 21 hours. After the 21 hours, the cultures were then adjusted with fresh medium without ethanol to have the same OD600 0.3. To one set of flasks, glucose was added to a final concentration of 3.4%. The other set of flasks was given an equivalent volume of water. The flasks were incubated at 30° C., 250 RPM in a New Brunswick Scientific I24 shaker for 5 minutes. After 5 minutes, the cultures were centrifuged at 4,000×g for 5 minutes at room temperature and resuspended in 70 ml of the above medium without ethanol. The cultures were added to 500 ml vented Erlenmeyer flasks and two glucose feed beads were added to each flask. The OD600 for the PNY1562 cultures was approximately 0.24 and the OD600 for the PNY2289 cultures was approximately 0.31. The cultures were grown at 30° C., 250 RPM in a New Brunswick Scientific I24 shaker for 24 hours.

Following the 24 hours of growth under low glucose conditions, after the cultures received either a 5 minute pulse of 3.4% glucose or just water, the cultures were sampled for OD600, isobutanol, and isobutyric acid. Culture supernatants (collected using Spin-X centrifuge tube filter units, Costar Cat. No. 8169) were analyzed by HPLC (method described in U.S. Patent Appl. Pub. No. US 2007/0092957, incorporated by reference herein) to determine the concentrations of isobutanol and isobutyric acid. OD600 and isobutanol and isobutyric acid concentrations are presented in Table 17. For the cultures that received the water, isobutyric acid accumulated for PNY1562, but no isobutyric acid was detected for PNY2289. For the cultures that received a 5 minute pulse of 3.4% glucose and then were grown for 24 hours under low glucose conditions, PNY1562 accumulated more isobutyric acid than PNY2289.

TABLE 17

| Strain | OD600 | Isobutyric Acid (mM) | Isobutanol (mM) |
| --- | --- | --- | --- |
| PNY1562 + water | 1.14 | 1.25 | n.d. |
| PNY2289 + water | 1.62 | n.d. | n.d. |
| PNY1562 + 5 minute glucose pulse | 1.18 | 1.52 | n.d. |
| PNY2289 + 5 minute glucose pulse | 1.84 | 0.24 | n.d. | n.d. = not detected

Example 8

Isobutanol Production in PNY2289 and PNY1562 Grown in Glucose Excess Conditions

This example demonstrates the isobutanol profile in the glucose-responsive strain PNY2289 and the control strain PNY1562 for cells that had been grown in glucose excess conditions, 3% final concentration.

PNY2289 and PNY1562 were first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, and 0.5% ethanol. An overnight culture was grown in 30 mL of medium in a 250 mL vented Erlenmeyer flask at 30° C., 250 RPM in a New Brunswick Scientific 124 shaker. The overnight cultures were centrifuged at 4,000×g for 5 minutes at room temperature and resuspended in the above medium without ethanol. For each strain, three 250 ml vented flasks containing the above medium without ethanol were inoculated with culture to an OD600 0.05 in a final volume of 30 ml. One 12 mm Kuhner Shaker FeedBead Glucose disc was added to each flask and the cultures were grown at 30° C., 250 RPM in a New Brunswick Scientific I24 shaker for 18 hours. The cultures were then diluted with fresh medium to an OD600 0.25 and 50% glucose was added to a final concentration of 3%. 13 ml of culture was transferred to a new 125 ml vented Erlenmeyer flask and grown at 30° C., 250 RPM in a New Brunswick Scientific I24 shaker for four hours. After four hours, the cultures were transferred to 20 ml serum vials (Kimble Chase, Vineland, N.J.), sealed, and grown at 30° C., 250 RPM in a New Brunswick Scientific I24 shaker for 65 hours.

After 65 hours, the cultures were sampled for OD600 and isobutanol. Culture supernatants (collected using Spin-X centrifuge tube filter units, Costar Cat. No. 8169) were analyzed by HPLC (method described in U.S. Patent Appl. Pub. No. US 2007/0092957, incorporated by reference herein) to determine the concentration of isobutanol. OD600 and isobutanol concentration are presented in Table 18 as the average of three cultures for each strain grown under glucose excess (3% final) conditions. Isobutanol was produced by both PNY1562 and PNY2289.

TABLE 18

| Strain | OD600 | Isobutanol (mM) |
| --- | --- | --- |
| PNY1562 | 1.61 | 95 |
| PNY2289 | 1.54 | 79 |

Example 9

Effect of Glucose on Promoter-GFP Fusions in PNY1631, PNY1632, PNY1633, PNY1634, PNY1635, and PNY1636

This example demonstrates the response of selected promoters in isobutanologen strains to the addition of glucose to 3% (final concentration) after cells had been growing under low glucose conditions. Polymer-based slow-release feed beads (Kuhner Shaker, Basel, Switzerland) were used for the low glucose condition.

PNY1631, PNY1632, PNY1633, PNY1634, PNY1635, and PNY1636 were first grown in synthetic medium (Yeast Nitrogen Base without Amino Acids (Sigma-Aldrich, St. Louis, Mo.) and Yeast Synthetic Drop-Out Media Supplement without uracil, histidine, leucine, and tryptophan (Sigma-Aldrich, St. Louis, Mo.)) supplemented with 76 mg/L tryptophan, 380 mg/L leucine, 100 mM MES pH5.5, and 0.5% ethanol. Overnight cultures were grown in 20 mL of medium in a 125 mL vented Erlenmeyer flask at 30° C., 250 RPM in a New Brunswick Scientific I24 shaker. The overnight cultures were centrifuged at 4,000×g for 5 minutes at room temperature and resuspended in the above medium without ethanol. Duplicate 250 ml vented flasks containing the above medium without ethanol were inoculated to an OD600 0.05 in a final volume of 35 ml for each strain. One 12 mm Kuhner Shaker FeedBead Glucose disc was added to each flask and the cultures were grown at 30° C., 250 RPM in a New Brunswick Scientific I24 shaker for 23 hours. After the 23 hours, glucose was added to one of the duplicate flasks for each strain to a final concentration of 3%, while the other duplicate flask was maintained. Growth was continued for 30 hours at 30° C., 250 RPM in a New Brunswick Scientific 124 shaker. Samples were taken prior to the addition of glucose and periodically throughout the 30 hour time period to measure OD600 and monitor promoter activity, as measured by the amount of fluorescence, using a flow cytometer.

Fluorescence was measured on a C6 Flow Cytometer (Accuri Cytometers, Inc., Ann Arbor, Mich.). Fluorescence was measured on the FL1 channel with excitation at a wavelength of 488 nm and emission detection at a wave length of 530 nm. The flow cytometer was set to measure 10,000 events at the medium flow rate (35 µl/min). Prior to loading samples on the flow cytometer, they were diluted in medium to an approximate OD600 0.1 to keep the rate of events lower than 1000 per second to ensure single cell counting.

Figure 10:
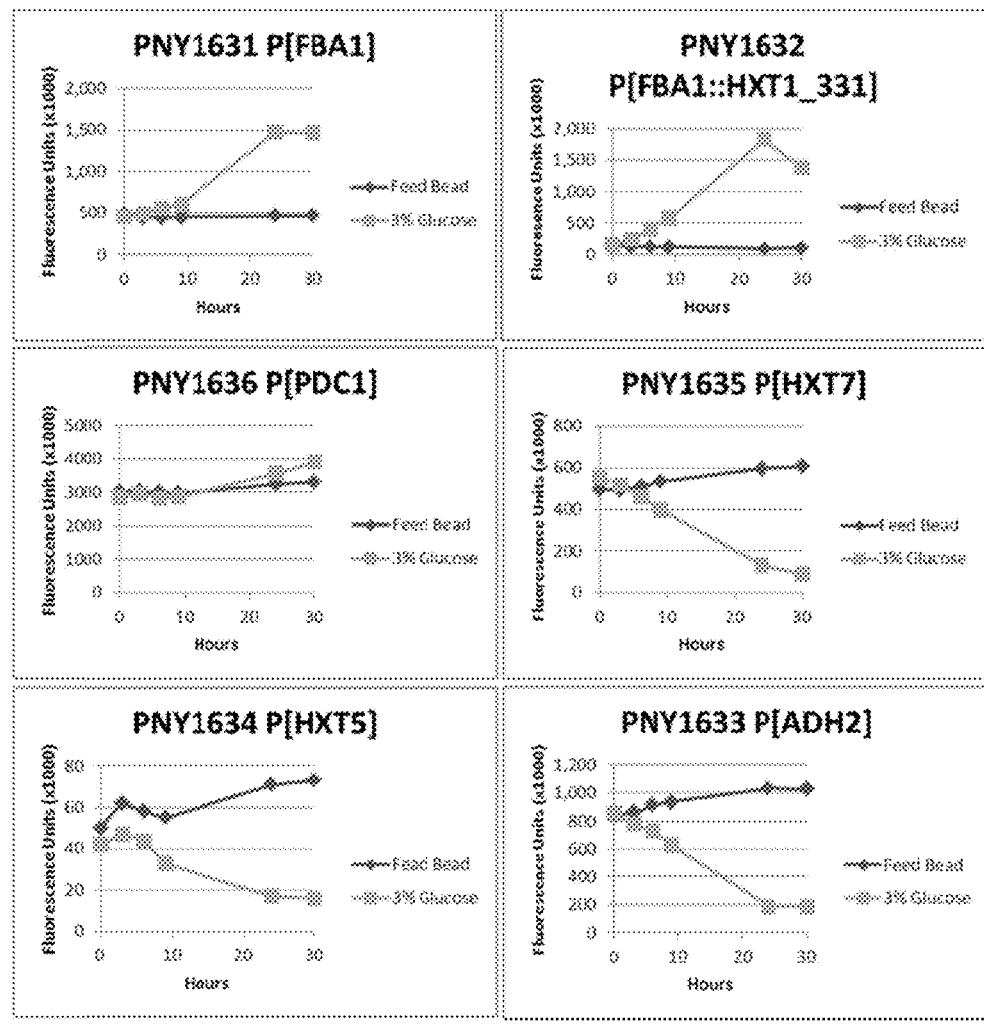
FIG. 10 shows the effect of addition of 3% glucose on promoter-GFP fusions, as described in Example 9.

Table 19 shows the cell growth for the strains at time 0 and time 30 hours for the cultures with or without the addition of glucose to 3%. FIG. 10 shows the mean fluorescence for the 10,000 events measured at each time point for each strain with or without the addition of glucose to 3%. PNY1632, the isobutanologen strain containing a promoter GFP fusion with the FBA1::HXT1_331 promoter engineered to be regulated by glucose in a similar fashion as the native low affinity HXT1 promoter, had fluorescence levels increase up to 11.2-fold after the addition of glucose. PNY1631, with the FBA1 promoter-GFP fusion, displayed a 3.2-fold increase in the mean fluorescence, while the PDC1 promoter-GFP strain, PNY1636, had fluorescence levels increase by only 38%. The three isobutanologen strains PNY1633, PNY1634, and PNY1635 containing the promoter-GFP fusions with the glucose repressed promoters ADH2, HXT5, and HXT7 had decreases in mean fluorescence of 4.5-fold, 2.6-fold, and 6-fold, respectively, after the addition of glucose to 3%.

TABLE 19

OD600 of cultures of strains with or without the addition of glucose to 3%.

| Strain | 0 hr No glucose addition culture | 30 hr No glucose addition culture | 0 hr 3% glucose addition culture | 30 hr 3% glucose addition culture |
|---|---|---|---|---|
| PNY1631 | 0.31 | 0.75 | 0.23 | 2.60 |
| PNY1632 | 0.33 | 1.00 | 0.25 | 3.22 |
| PNY1633 | 0.46 | 1.02 | 0.24 | 2.68 |
| PNY1634 | 0.29 | 0.86 | 0.24 | 2.37 |
| PNY1635 | 0.36 | 0.85 | 0.24 | 2.54 |
| PNY1636 | 0.32 | 0.80 | 0.24 | 2.40 |

Example 10

Glucose-Limited Growth of PNY1559, PNY1560, and PNY1562

This example demonstrates growth of strain PNY1559, PNY1560 and PNY1562 under aerobic and glucose-limited conditions. 125 ml shake flasks filled with 10 ml SEED medium were inoculated with 1 tube of thawed glycerol stock cultures (approximately 1 ml). After 24 h 3.51 ml, 3.65 ml and 3.81 for strain PNY1559, PNY1560 and PNY1562, respectively, were transferred into 500 ml shake flasks filled with 100 ml of STAGE1 medium. SEED medium was composed of 50% Yeast Synthetic Medium (2×), 10% Double Drop-Out Supplements Complete Supplement Mixture (CSM) without histidine and uracil (Formedium, DSCK162, Hunstanton, UK), 0.63% ethanol and 39.37% of water. Yeast Synthetic Medium (2×) in turn was composed of 13.4 g/l Yeast Nitrogen Base w/o amino acids (Difco 0919-15-3), 40 mg/l thiamine, 40 mg/l niacin and 200 ml/l of a 1 M MES buffer, pH=5.5. STAGE1 medium was composed of 50% Yeast Synthetic Medium (2×), 10% Double Drop-Out Supplements Complete Supplement Mixture (CSM) without histidine and uracil (Formedium, DSCK162, Hunstanton, UK) and 40% of water. The cultures were subsequently incubated at 30° C. and 250 rpm in an Innova Laboratory Shaker (New Brunswick Scientific, Edison, N.J.). At 2 h, 8 h, 17.5 h and 25 h of the process, each time one large glucose feed bead (D=12 mm, Kuhner shaker, Birsfelden, CH) was added to each culture. Samples were withdrawn to monitor growth and product formation. HPLC analysis was applied to determine concentration of glucose, isobutyric acid c(iac) and isobutanol c(iso) in the culture medium. Biomass concentration of the cultures were monitored by an Ultrospec 3000 spectrophotometer (Pharmacia Biotech) at λ=600 nm. No glucose was detected in the supernatant of all the cultures with the exception of samples withdrawn at EPT=4 h and EPT=17.17 h. Nevertheless, at these two sample times detected glucose concentrations in all cultures were below 0.1 mM (18 mg/L), indicating that all the cultures were grown under glucose-limiting conditions. Observed biomass, concentration of isobutyric acid and isobutanol are given in Table 20. Strains PNY1559 and PNY1560 achieved comparable biomass concentration on the released glucose. Strains PNY1559 and PNY1560 achieved significant higher biomass concentration of the released glucose than strain PNY1562. No significant production of isobutanol was detected in all of the cultures. No significant production of isobutyric acid was detected in cultures of strain PNY1559 and PNY1560. Production of isobutyric acid was detected with strain PNY1562.

TABLE 20

Optical density and concentration of isobutyric acid (c(iac)) and isobutanol (c(iso)) of stage 1 aerobic and glucose-limited cultures of strains PNY1559, PNY1560 and PNY1562.

| | PNY 1559 | | | PNY 1560 | | | PNY 1562 | | |
|---|---|---|---|---|---|---|---|---|---|
| EPT [h] | OD [ ] | c(iac) [mM] | c(iso) [mM] | OD [ ] | c(iac) [mM] | c(iso) [mM] | OD [ ] | c(iac) [mM] | c(iso) [mM] |
| 0.00 | 0.149 | 0.00 | 0.00 | 0.147 | 0.00 | 0.00 | 0.150 | 0.00 | 0.00 |
| 2.00 | 0.155 | 0.00 | 0.00 | 0.165 | 0.00 | 0.00 | 0.169 | 0.00 | 0.00 |
| 4.00 | 0.186 | 0.00 | 0.00 | 0.202 | 0.00 | 0.00 | 0.181 | 0.00 | 0.00 |
| 8.00 | 0.354 | 0.00 | 0.00 | 0.354 | 0.00 | 0.00 | 0.285 | 0.00 | 0.00 |
| 17.17 | 0.816 | 0.00 | 0.00 | 0.801 | 0.00 | 0.00 | 0.566 | 0.00 | 0.00 |
| 20.00 | 0.941 | 0.00 | 0.00 | 0.916 | 0.00 | 0.00 | 0.656 | 0.27 | 0.00 |
| 24.83 | 1.226 | 0.00 | 0.00 | 1.191 | 0.00 | 0.00 | 0.811 | 0.39 | 0.00 |
| 41.17 | 2.201 | 0.00 | 0.00 | 2.151 | 0.00 | 0.00 | 1.441 | 0.73 | 0.00 |

Example 11

Increased Biomass Yield in Glucose-Limited Growth of PNY1559 and PNY1560 Compared to PNY1562

This example demonstrates significant higher biomass yields on glucose of strains PNY1559 and PNY1560 under aerobic, glucose limited growth as compared to strain PNY1562. Experiment was run as described in Example 10. Total glucose released and biomass formed were balanced. For the large feed beads (D=12 mm, Kuhner shaker, Birsfelden, CH), a glucose release kinetics according to m(glc)=2.06 mg/h0.63×EPT0.63 was assumed. Complete consumption of the released glucose was used for calculations. Released glucose m(glc) as well as total formed biomass m(cdw) were determined at time points EPT=8, 17, 20, 25 and 41 h. Prior time points were discarded as in selected cultures other carbon sources than glucose (e.g. ethanol) had been found in the supernatant. Total formed biomass m(cdw) was determined by measuring optical density (OD) with an Ultrospec 3000 spectrophotometer (Pharmacia Biotech) set at $\lambda$=600 nm and applying a conversion of 0.33 g(cdw)/OD. Mass balances were derived taking into account sample volume withdrawn during the experiment as well as evaporation of water from the broth at a rate of 0.042 ml/h (Table 22).

TABLE 21

Sample volume withdrawn (sample), resulting volume in the shake flasks (volume) as well as schedule for addition of large glucose feed beads (D = 12 mm, Kuhner shaker, Birsfelden, CH). The same scheme was assumed to be valid for cultures of PNY1559, PNY1560 and PNY1562

| EPT [h] | sample [ml] | volume [ml] | tablets added [no] |
|---|---|---|---|
| 0.0 | 1.50 | 98.50 | |
| 2.0 | 1.50 | 96.92 | +1 |
| 4.0 | 1.50 | 95.33 | |
| 8.0 | 1.50 | 93.66 | +1 |
| 17.0 | 1.50 | 91.79 | |
| 17.5 | | 91.77 | +1 |
| 20.0 | 1.50 | 90.16 | |
| 25.0 | 9.50 | 80.45 | +1 |
| 41.0 | 1.50 | 78.28 | |

TABLE 22

Total glucose released m(glc) and total cell dry weight produced m(cdw) for strains PNY1559, PNY1560 and PNY1562

| | PNY 1559 | | PNY 1560 | | PNY 1562 | |
|---|---|---|---|---|---|---|
| EPT [h] | m(glc) [mg] | m(cdw) [mg] | m(glc) [mg] | m(cdw) [mg] | m(glc) [mg] | m(cdw) [mg] |
| 8.0 | 6.4 | 11.4 | 6.4 | 11.4 | 6.4 | 9.2 |
| 17.0 | 19.6 | 25.5 | 19.6 | 25.1 | 19.6 | 17.8 |
| 20.0 | 26.3 | 29.3 | 26.3 | 28.5 | 26.3 | 20.5 |
| 25.0 | 34.5 | 37.7 | 34.5 | 36.6 | 34.5 | 25.1 |
| 41.0 | 66.2 | 63.1 | 66.2 | 61.7 | 66.2 | 41.5 |

Linear regression with Microsoft Office Excel 2003 SP3 (Microsoft, Redmond, Wash.) with the released glucose at the x-axes and the formed biomass on the y-axes revealed the biomass yield coefficient in [g/g] for the three cultures as the slope. Correlation coefficient R2 for the fitted lines of all three cultures was >0.99. The biomass yields on glucose determined at the given experimental conditions were 0.85 g/g for PNY1559, 0.83 g/g for PNY1560, and 0.53 g/g for PNY1562. It can be seen that the biomass yields of PNY1559 and PNY1560 on glucose were significantly higher than of PNY1562.

Example 12

Expression of ALS in PNY1559, PNY1560, and PNY1562 Under First Aerobic and Glucose-Limited and after Addition of Glucose in Aerobic, Glucose-Excess Conditions This example demonstrates growth of strain PNY1559, PNY1560 and PNY1562 under aerobic and glucose-limited conditions. 125 ml shake flasks filled with 10 ml SEED medium were inoculated with 1 tube of thawed glycerol stock cultures (approximately 1 ml). After 24 h 3.51 ml, 3.65 ml and 3.81 ml for strain PNY1559, PNY1560 and PNY1562, respectively, were transferred into 500 ml shake flasks filled with 100 ml of STAGE1 medium. SEED medium was composed of 50% Yeast Synthetic Medium (2×), 10% Double Drop-Out Supplements Complete Supplement Mixture (CSM) without histidine and uracil (Formedium, DSCK162, Hunstanton, UK), 0.63% ethanol and 39.37% of water. Yeast Synthetic Medium (2×) in turn was composed of 13.4 g/l Yeast Nitrogen Base w/o amino acids (Difco 0919-15-3), 40 mg/l thiamine, 40 mg/l niacin and 200 ml/l of a 1 M MES buffer, pH=5.5. STAGE1 medium was composed of 50% Yeast Synthetic Medium (2×), 10% Double Drop-Out Supplements Complete Supplement Mixture (CSM) without histidine and uracil (Formedium, DSCK162, Hunstanton, UK) and 40% of water. The cultures were subsequently incubated at 30° C. and 250 rpm in an Innova Laboratory Shaker (New Brunswick Scientific, Edison, N.J.). At 2 h, 8 h, 17.5 h and 25 h of the process, each time one large glucose feed bead (D=12 mm, Kuhner shaker, Birsfelden, CH) was supplemented into each culture. At EPT=41.33 h a glucose bolus of 5 ml of a 50% glucose solution was added to the cultures. Samples for determination of ALS mRNA level were drawn before (EPT=24.83 h and 41.17 h) and after addition of excess glucose (EPT=42.83 h, 44.08 h, 46.08 h, 48.33 h and 65.33 h). Samples for specific ALS enzyme activity were drawn before (EPT=41.17 h) and after (EPT=48.33 h and EPT=65.33 h) the glucose bolus.

For ALS transcript analysis, culture samples (Table 23) were withdrawn and added to an ice cold 15 ml conical tube containing 4 ml of ice cold water and centrifuged at 4,000×g for 4 minutes at 4° C. Pellets were immediately resuspended in 1 ml of Trizol (Invitrogen, Carlsbad, Calif.), frozen on dry ice and then stored at −80° C. until RNA extraction. For RNA extraction, samples were thawed on ice and transferred to 2 ml screw cap tubes containing Lysing Matrix B 0.1 mm silica spheres (MP Biomedicals, Solon, Ohio). The samples were subjected to a bead beater two times at maximum speed for one minute. 200 µl of chloroform was added and samples vortexed. The samples were centrifuged at 13,000×g for 15 minutes at 4° C. 600 µl of aqueous phase was added to 650 µl of 70% ethanol and mixed. The sample was applied to Qiagen RNeasy Kit (Qiagen, Valencia, Calif.) spin columns and the manufacturer's protocol was followed. RNA was eluted from the column with 50 µl RNase-free water. RNA samples were stored at −80° C. until real time reverse transcription PCR analysis. 18S transcript was used as internal standard. Subsequently fold expression levels in the cultures were normalized to the expression level of strain PNY1560 at EPT=41.17 h and expressed in [AU] (arbitrary units).

TABLE 23

Sampled culture volume for ALS mRNA analysis for strains PNY1559, PNY1560 and PNY1562

| | mRNA | | | | | | |
|---|---|---|---|---|---|---|---|
| | EPT = 24.83 h [ml] | EPT = 41.16 h [ml] | EPT = 42.83 h [ml] | EPT = 44.08 h [ml] | EPT = 46.08 h [ml] | EPT = 48.33 h [ml] | EPT = 65.33 h [ml] |
| PNY1559 | 8.00 | 5.00 | 5.00 | 5.00 | 5.00 | 5.00 | 5.00 |
| PNY1560 | 8.00 | 5.00 | 5.00 | 5.00 | 5.00 | 5.00 | 5.00 |
| PNY1562 | 8.00 | 5.00 | 5.00 | 5.00 | 5.00 | 5.00 | 5.00 |

For determination of specific ALS enzyme activity, culture samples were transferred into 50 ml centrifuge tubes (VWR, Radnor, Pa.) and centrifuged for 10 min at 5000 rpm and 4° C. in an Eppendorf 5804R centrifuge (Hamburg, Germany). Pellets were subsequently frozen on dry ice and then stored at −80° C. until assayed for ALS activity. Frozen pellets were thawed, resuspended in 1.5 mL 0.1 M K-Hepes pH 6.8 containing 10 mM MgCl2 and a protease inhibitor cocktail (Roche, Catalog #11873580001), and then broken by bead beating with 0.5 mm glass beads. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). ALS enzyme activities were measured spectrophotometrically in an end point assay using the method as described in W W Westerfeld (1945), J. Biol. Chem, 161, 495-502, with modifications. The assay buffer contained 0.1 M K-Hepes pH 6.8, 10 mM MgCl2, and 0.5 mM TPP. Sufficient sodium pyruvate was added to assay buffer so that the final concentration in the assay was 50 mM. In each assay, an enzyme containing solution and substrate containing buffer were mixed so that the final volume was 500 ul. Assay mixtures were incubated at 30 degree C. for 45 minutes. At fifteen minute intervals, a 100 ul aliquot of each reaction was mixed with 10 ul of a 6 N of sulfuric acid in H2O. Following a 15 minute incubation at 60 C, 500 µl of 0.2% creatine in H2O and 500 µl 1.5% a-naphthol in 2.5 N NaOH were added. After brief mixing, the samples were heated to 60 degrees C. for 15 min, cooled briefly, and the absorbance of the mixture was read at $\lambda$=530 nm with a Spectra Max384 Plus plate reader (Molecular Devices, Sunnyvale, Calif.). The slope of a standard curve for 0 to 0.63 mM acetoin, reaction rate (OD/min), and protein concentration (mg/mL) were used to calculate specific ALS enzyme activities (U/mg) of each sample.

TABLE 24

Sampled culture volumes for analysis of ALS enzyme activity for strains PNY1559, PNY1560 and PNY1562

| | protein | | |
|---|---|---|---|
| | EPT = 41.16 h [ml] | EPT = 48.33 h [ml] | EPT = 65.33 h [ml] |
| PNY1559 | 15.00 | 10.00 | 10.00 |
| PNY1560 | 15.00 | 10.00 | 10.00 |
| PNY1562 | 15.00 | 10.00 | 10.00 |

Biomass concentrations of the cultures were monitored by OD measured with an Ultrospec 3000 spectrophotometer (Pharmacia Biotech, Piscataway, N.J.) at $\lambda$=600 nm. Cell dry weight concentration was deferred from the OD readings assuming an OD-DW-correlation of 0.33 g(DW)/OD. Extracellular compound analysis in supernatant was accomplished by HPLC. A BIO-RAD Aminex HPX-87H column was used in an isocratic method with 0.01 N sulfuric acid as eluent on a Waters Alliance 2695 Separations Module (Milford, Mass.). Flow rate was 0.60 ml/min, column temperature 40° C., injection volume 10 µl and run time 58 min. Detection was carried out with a refractive index detector (Waters 2414 RI) operated at 40° C. and an UV detector (Waters 2996 PDA) at 210 nm.

Consistently low ALS mRNA levels were detected in strain PNY1559 during aerobic glucose-limited as well as during aerobic glucose-excess cultivation (average in all 7 samples: 0.02±0.04 AU). In PNY1562, consistently high ALS mRNA levels were found during both process conditions (average in all 7 samples: 193.02±45.04 AU). In contrast, in PNY1560, low ALS mRNA levels were found during aerobic, glucose-limited growth (average of 2 samples: 0.75±0.35 AU), but high mRNA levels during aerobic, glucose-excess growth (average of 5 samples: 16.83±11.70 AU). It can also be seen that the ALS mRNA level in PNY1560 after addition of the glucose bolus is constantly increasing with time of the experiment, from 1.00 AU before the bolus and 7.37 AU right after the bolus to 35.22 AU at the end of the experiment at EPT=65.33 h. An increasing ALS mRNA level in strain PNY1560 indicates that transcription of the ALS gene mediated by the HXT3 promoter is low during low glucose, but increases significantly at high glucose concentrations.

Consistently low specific ALS enzyme activities were detected in strain PNY1559 during aerobic glucose-limited as well as during aerobic glucose-excess cultivation (average in all 3 samples: 0.01±0.00 U). In PNY1562, consistently high specific ALS enzyme activities were found during both process conditions (average in all 3 samples: 1.03±0.08 AU). In contrast, in PNY1560, low specific ALS enzyme activity was found during aerobic, glucose-limited growth (0.01 U), but steadily increasing enzyme activity was found during aerobic, glucose-limited growth (0.08 U at EPT=48.33 h and 0.11 U at EPT=65.33 h). These findings illustrate that increased expression of the ALS gene as mediated by the HXT3 promoter results in an increased specific ALS enzyme activity at high extracellular glucose concentration as compared to low extracellular glucose concentrations.

ditions was observed in strain PNY1559. In strain PNY1562 isobutyric acid production was observed during aerobic, glucose-limited conditions as well as during aerobic, glucose-excess conditions. In strain PNY1560 no isobutyric acid production during aerobic, glucose-limited conditions was observed, but during aerobic, glucose-excess conditions isobutyric acid production was observed. The observation of

TABLE 25

ALS mRNA levels (RNA(ALS)) given in arbitrary units (AU) and specific ALS enzyme activities (Prot(ALS)) given in units (U) for aerobic and glucose-limited (EPT < 41.33 h) and aerobic and glucose-excess (EPT > 41.33 h) cultures of strains PNY1559, PNY1560 and PNY1562

| | PNY 1559 | | PNY 1560 | | PNY 1562 | |
|---|---|---|---|---|---|---|
| EPT [h] | RNA(ALS) [AU] | Prot(ALS) [U] | RNA(ALS) [AU] | Prot(ALS) [U] | RNA(ALS) [AU] | Prot(ALS) [U] |
| 24.83 | 0.00 | n.d. | 0.51 | n.d. | 200.43 | n.d. |
| 41.17 | 0.01 | 0.01 | 1.00 | 0.01 | 201.13 | 1.00 |
| 42.83 | 0.00 | n.d. | 7.37 | n.d. | 242.95 | n.d. |
| 44.08 | 0.00 | n.d. | 8.73 | n.d. | 157.54 | n.d. |
| 46.08 | 0.00 | n.d. | 11.24 | n.d. | 168.56 | n.d. |
| 48.33 | 0.11 | 0.01 | 21.57 | 0.08 | 252.24 | 0.96 |
| 65.33 | 0.00 | 0.01 | 35.22 | 0.11 | 128.28 | 1.12 |

No isobutanol production, neither during aerobic, glucose-limited nor during aerobic, glucose-excess conditions was observed in strain PNY1559. In strain PNY1562 no isobutanol production during aerobic, glucose-limited conditions, but during aerobic, glucose-excess conditions was observed. In strain PNY1560 no isobutanol production during aerobic, glucose-limited conditions was observed, but during aerobic, glucose-excess conditions isobutanol production was observed. No isobutyric acid production, neither during aerobic, glucose-limited nor during aerobic, glucose-excess conditions was observed in strain PNY1559. In strain PNY1562 isobutyric acid production was observed during aerobic, glucose-limited conditions as well as during aerobic, glucose-excess conditions. In strain PNY1560 no isobutyric acid production during aerobic, glucose-limited conditions was observed, but during aerobic, glucose-excess conditions isobutyric acid production was observed. The observation of no isobutyric acid and isobutanol formation in strain PNY1560 during aerobic, glucose-limited conditions, but isobutyric acid and isobutanol formation during aerobic, glucose-excess conditions indicate carbon flux from glucose through ALS, the expression of which is mediated by the HXT3 promoter, to isobutyraldehyde in strain PNY1560 depends on the concentration of extracellular glucose, with high carbon flux at high glucose concentration, and low/non-detectable carbon flux at low glucose concentrations.

TABLE 26

Concentrations of selected compounds in the culture medium of strain PNY1559.

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | mBDO [mM] | d/lBDO [mM] | acetoin [mM] | lactate [mM] | succinate [mM] |
|---|---|---|---|---|---|---|---|---|---|---|---|---|---|---|---|
| 0.00 | 0.149 | << | 0.8 | << | << | << | 8.8 | 0.5 | << | << | << | << | << | << | << |
| 2.00 | 0.155 | << | 0.6 | << | << | << | 8.8 | 0.5 | << | << | << | << | << | << | << |
| 4.00 | 0.186 | 0.1 | 0.4 | << | << | << | 8.8 | 0.6 | << | << | << | << | << | << | << |
| 8.00 | 0.354 | << | << | << | << | << | 8.7 | << | << | << | << | << | << | << | << |
| 17.17 | 0.816 | << | << | << | << | << | 8.6 | << | << | << | << | << | << | << | << |
| 20.00 | 0.941 | 0.0 | << | << | << | << | 8.6 | << | << | << | << | << | << | << | << |
| 24.83 | 1.226 | << | << | << | << | << | 8.6 | << | << | << | << | << | << | << | << |
| 41.17 | 2.201 | << | << | << | << | << | 7.8 | << | << | << | << | << | << | << | << |
| 41.33 | 2.041 | 260.8 | << | << | << | << | 7.3 | << | << | << | << | << | << | << | << |
| 42.83 | 1.991 | 260.6 | 0.4 | 0.9 | << | << | 7.6 | << | << | << | << | << | << | << | << |
| 44.08 | 1.912 | 259.3 | << | 2.1 | 0.0 | << | 7.8 | 0.4 | << | << | << | << | << | << | << |
| 46.08 | 1.961 | 258.8 | << | 4.8 | 0.1 | << | 8.3 | 1.1 | << | << | << | << | << | 0.1 | << |
| 48.33 | 2.131 | 257.5 | 0.6 | 8.3 | 0.2 | << | 8.8 | 1.5 | << | << | << | << | << | 0.2 | << |
| 65.33 | 2.691 | 247.1 | << | 22.2 | 0.7 | 0.7 | 9.3 | 3.9 | 0.8 | << | << | << | 0.6 | << | 0.5 |

"<<" indicates concentrations below detection limit.

Glucose bolus was administered to the culture at EPT = 41.33 h directly before the measurement

TABLE 27

Concentrations of selected compounds in the culture medium of strain PNY1560.

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | mBDO [mM] | d/lBDO [mM] | acetoin [mM] | lactate [mM] | succinate [mM] |
|---|---|---|---|---|---|---|---|---|---|---|---|---|---|---|---|
| 0.00 | 0.147 | << | 0.6 | << | << | << | 8.9 | 0.6 | << | << | << | << | << | << | << |
| 2.00 | 0.165 | << | 0.5 | << | << | << | 8.7 | 0.5 | << | << | << | << | << | << | << |
| 4.00 | 0.202 | 0.1 | 0.3 | << | << | << | 8.7 | << | << | << | << | << | << | << | << |
| 8.00 | 0.354 | << | << | << | << | << | 8.6 | << | << | << | << | << | << | << | << |
| 17.17 | 0.801 | 0.0 | << | << | << | << | 8.5 | << | << | << | << | << | << | << | << |
| 20.00 | 0.916 | << | << | << | << | << | 8.5 | << | << | << | << | << | << | << | << |
| 24.83 | 1.191 | << | << | << | << | << | 8.4 | << | << | << | << | << | << | << | << |
| 41.17 | 2.151 | << | << | << | << | << | 7.8 | << | << | << | << | << | << | << | << |
| 41.33 | 2.031 | 259.6 | << | << | << | << | 7.2 | << | << | << | << | << | << | << | << |
| 42.83 | 1.961 | 260.1 | 0.3 | 0.7 | << | << | 7.4 | << | << | << | << | << | << | << | << |
| 44.08 | 1.891 | 260.2 | << | 1.4 | 0.0 | << | 7.8 | 0.4 | << | << | << | << | << | << | << |
| 46.08 | 1.921 | 258.5 | << | 3.0 | 0.1 | 0.1 | 8.3 | 0.8 | 0.5 | << | << | << | << | << | << |
| 48.33 | 2.141 | 256.0 | << | 4.7 | 0.2 | 0.6 | 8.9 | 1.4 | 0.9 | << | << | << | << | 0.1 | 0.1 |
| 65.33 | 2.661 | 236.1 | << | 9.5 | 1.1 | 5.1 | 10.7 | 3.3 | 3.9 | 1.0 | 1.7 | 0.3 | << | << | 0.4 |

"<<" indicates concentrations below detection limit.
Glucose bolus was administered to the culture at EPT = 41.33 h directly before the measurement

TABLE 28

Concentrations of selected compounds in the culture medium of strain PNY1562.

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | mBDO [mM] | d/lBDO [mM] | acetoin [mM] | lactate [mM] | succinate [mM] |
|---|---|---|---|---|---|---|---|---|---|---|---|---|---|---|---|
| 0.00 | 0.150 | << | 0.4 | << | << | << | 9.6 | 0.6 | << | << | << | << | << | << | << |
| 2.00 | 0.169 | << | 0.2 | << | << | << | 9.5 | 0.6 | << | << | << | << | << | << | << |
| 4.00 | 0.181 | 0.1 | << | << | << | << | 9.6 | 0.7 | << | << | << | << | << | << | << |
| 8.00 | 0.285 | << | << | << | << | << | 9.6 | << | << | << | << | << | << | << | << |
| 17.17 | 0.566 | << | << | << | << | << | 9.5 | << | << | << | << | << | << | << | << |
| 20.00 | 0.656 | 0.0 | << | << | << | << | 9.6 | << | 0.3 | << | << | << | << | << | << |
| 24.83 | 0.811 | << | << | << | << | << | 9.4 | << | 0.4 | << | << | << | << | << | << |
| 41.17 | 1.441 | << | << | << | 0.0 | 0.3 | 9.0 | << | 0.7 | << | << | << | << | << | << |
| 41.33 | 1.301 | 259.5 | << | << | 0.0 | 0.3 | 8.3 | << | 0.7 | << | << | << | << | << | << |
| 42.83 | 1.261 | 258.9 | << | << | 0.0 | 0.4 | 8.4 | << | 0.9 | << | << | << | << | << | << |
| 44.08 | 1.247 | 259.6 | << | << | 0.1 | 0.5 | 8.7 | << | 1.2 | << | << | << | << | << | << |
| 46.08 | 1.281 | 257.1 | << | 0.0 | 0.1 | 0.7 | 8.9 | << | 1.6 | << | << | << | << | << | << |
| 48.33 | 1.331 | 256.0 | << | 0.0 | 0.2 | 1.0 | 9.2 | << | 2.3 | 0.6 | << | << | << | << | << |
| 65.33 | 1.811 | 251.2 | << | 0.2 | 0.7 | 3.8 | 10.9 | << | 6.2 | 1.3 | << | << | 2.0 | << | 0.3 |

"<<" indicates concentrations below detection limit.
Glucose bolus was administered to the culture at EPT = 41.33 h directly before the measurement Example 13

Isobutanol Production in PNY1560 and PNY1562 During Transition from Aerobic, Glucose-Excess to Anaerobic, Glucose-Excess Conditions This example demonstrates production of isobutanol in PNY1560 during transition from aerobic, glucose-excess to anaerobic, glucose-excess conditions. 3.3 ml and 6.7 ml of cultures from PNY1560 and PNY1562 were each transferred at the end of the experiment described in Examples 10-12 into a 50 mL sterile centrifuge tube and spun down at 9500 rpm for 20 min. The pellet was subsequently re-suspended in 12 ml of production medium and transferred into 25 ml Balch tubes. Production medium was composed of 50% Yeast Synthetic Medium (2×), 10% Double Drop-Out Supplements Complete Supplement Mixture (CSM) without histidine and uracil (Formedium, DSCK162, Hunstanton, UK), 16% of a 250 g/l glucose solution, and 24% of water. Yeast Synthetic Medium (2×) in turn was composed of 13.4 g/l Yeast Nitrogen Base w/o amino acids (Difco 0919-15-3), 40 mg/l thiamine, 40 mg/l niacin and 200 ml/l of a 1 M MES buffer, pH=5.5. Each Balch tube was fitted with a butyl rubber septum and cramped to the tube with a sheet metal with circular opening to allow samples withdrawal by syringes. For sample withdrawal, 1 ml syringes (25G ⅝ (0.5 mm×16 mm) Safety-Lok, Becton Dickinson, Franklin Lakes, N.J.) were employed. Growth of the cultures was monitored with help of OD measured with an Ultrospec 3000 spectrophotometer (Pharmacia Biotech, Piscataway, N.J.) at λ=600 nm. Cell dry weight concentration was deferred from the OD readings assuming an OD-DW-correlation of 0.33 g(DW)/OD. Extracellular compound analysis in supernatant was accomplished by HPLC. A BIO-RAD Aminex HPX-87H column was used in an isocratic method with 0.01 N sulfuric acid as eluent on a Waters Alliance 2695 Separations Module (Milford, Mass.). Flow rate was 0.60 ml/min, column temperature 40° C., injection volume 10 μl and run time 58 min. Detection was carried out with a refractive index detector (Waters 2414 RI) operated at 40° C. and an UV detector (Waters 2996 PDA) at 210 nm.

It can be seen that PNY1560 produces isobutanol under the applied conditions. Average specific isobutanol production rate was determined to be 0.01 g/g(DW) h for PNY 1560 and 0.06 g/g(DW) h for PNY 1562. Average specific isobutanol production rate was calculated by dividing isobutanol concentration formed by the average biomass concentration in the experiment. Average biomass concentration was calculated by integration for the time of the experiment assuming exponential and subsequently linear growth of the biocatalyst and division of the result by the total time of experiment.

PNY1625, PNY1626, PNY1627, PNY1559 and PNY1562, respectively. Moreover, stirrer speed was reduced to 160 rpm to reduce oxygen supply and mimic an environment comparable to an isobutanol propagation and production tank.

During the experiments, samples for determining optical density at $\lambda=600$ nm with an Ultrospec 3000 spectrophotometer (Pharmacia Biotech), extracellular metabolite concentrations by HPLC and enzyme activities by enzymatic assays

TABLE 29

OD and by-products of PNY1560 and PNY1562 in a Balch tube experiment, starting at aerobic, glucose-excess conditions and transitioning into anaerobic, glucose-excess conditions at the end of the run.

| EPT [h] | OD [ ] | glucose [mM] | ethanol [mM] | pyruvate [mM] | KID [mM] | DHX [mM] | glycerol [mM] | acetate [mM] | isobutyrate [mM] | isobutanol [mM] | mBDO [mM] | d/l-BDO [mM] | acetoin [mM] | lactate [mM] | succinate [mM] |
|---|---|---|---|---|---|---|---|---|---|---|---|---|---|---|---|
| PNY1560 | | | | | | | | | | | | | | | |
| 0.00 | 1.056 | 231.6 | 7.2 | 0.0 | << | << | << | << | << | << | << | << | << | << | << |
| 3.00 | 1.031 | 230.0 | 7.6 | 0.2 | 0.0 | << | 0.5 | << | << | << | << | << | << | << | << |
| 8.00 | 1.061 | 229.2 | 7.8 | 0.3 | 0.1 | << | 0.9 | 0.3 | << | 1.1 | << | << | << | << | << |
| 24.33 | 1.121 | 224.5 | 8.9 | 0.8 | 0.1 | 0.2 | 2.3 | 0.7 | << | 3.5 | << | << | << | 0.3 | << |
| 48.33 | 1.251 | 215.5 | 10.3 | 1.5 | 0.2 | 0.6 | 4.1 | 1.2 | << | 7.0 | << | << | << | 0.5 | 0.1 |
| 72.00 | 1.101 | 209.2 | 11.5 | 2.1 | 0.2 | 0.9 | 5.8 | 1.7 | << | 9.8 | << | 0.2 | << | 0.8 | << |
| PNY1562 | | | | | | | | | | | | | | | |
| 0.00 | 0.991 | 230.5 | 7.2 | << | << | << | << | 0.2 | << | << | << | << | << | << | << |
| 3.00 | 1.071 | 229.0 | 7.2 | << | 0.1 | 0.1 | 0.5 | << | << | 0.9 | << | << | << | << | << |
| 8.00 | 1.171 | 229.7 | 7.9 | 0.0 | 0.2 | 0.3 | 1.3 | 0.4 | << | 3.2 | << | << | << | << | << |
| 24.33 | 1.311 | 207.9 | 7.8 | 0.2 | 0.9 | 1.2 | 6.0 | 0.7 | 0.5 | 16.1 | << | << | << | 0.1 | 0.1 |
| 48.33 | 1.501 | 167.9 | 8.6 | 1.0 | 3.0 | 3.3 | 16.4 | 1.6 | 0.9 | 39.4 | 0.5 | 0.3 | << | 0.4 | 0.2 |
| 72.00 | 1.241 | 136.9 | 9.0 | 1.9 | 4.3 | 5.4 | 23.9 | 2.8 | 0.7 | 56.2 | 0.9 | 0.6 | << | 0.5 | 0.4 |

Example 14

Isobutanol Production in PNY1623, PNY1624, PNY1625, PNY1626 and PNY1627

This example demonstrates production of isobutanol and isobutanol pathway intermediates in PNY1623, PNY1624, PNY1625, PNY1626 and PNY1627 under conditions of reduced oxygen supply. For this purpose 3 vials of frozen glycerol stocks of each strain, i.e. PNY1559, PNY1562, PNY1623, PNY1627, PNY1.625, PNY1626, and 2 vials of PNY1624 were inoculated into 100 ml of seed medium in a 500 ml shake flask. Each frozen glycerol stock vial contained approximately 1 ml of frozen stock culture. Seed medium was composed of 50% Yeast Synthetic Medium (2×), 30% Double Drop-Out Supplements Complete Supplement Mixture (CSM) without histidine and uracil (Formedium, DSCK162, Hunstanton, UK) and 20% of water. Yeast Synthetic Medium (2×) in turn was composed of 13.4 g/l Yeast Nitrogen Base w/o amino acids (Difco 0919-15-3), 40 mg/l thiamine, 40 mg/l niacin and 200 ml/l of a 1 M MES buffer, pH=5.5. Immediately after inoculation three small feed beads (D=6 mm, Kuhner shaker, Birsfelden, CH) were added to each Shake flask. The cultures were incubated at 30° C., in an Innova Laboratory Shaker (New Brunswick Scientific, Edison, N.J.) at 250 rpm. At EPT=4 h and EPT=20.5 h, 3 large feed beads were added to each culture. At EPT=25.83 h, cultures together with the feed beads were transferred from 500 ml to 125 ml shake flasks to reduce oxygen supply. However, cultures were continued to be grown under glucose limitation and to be shaken at 250 rpm. At EPT=75.00 h, 20 ml of 250 g/l glucose solution was added to each of the cultures to generate glucose excess conditions. Resulting culture volumes were 95 ml, 101 ml, 101 ml, 95 ml, 105 ml, 99 ml and 102 ml for cultures with strains PNY1623, PNY1624, where withdrawn. For HPLC analysis, a BIO-RAD Aminex HPX-87H column was used in an isocratic method with 0.01 N sulfuric acid as eluent on a Waters Alliance 2695 Separations Module (Milford, Mass.). Flow rate was 0.60 ml/min, column temperature 40° C., injection volume 10 µl and run time 58 min. Detection was carried out with a refractive index detector (Waters 2414 RI) operated at 40° C. and an UV detector (Waters 2996 PDA) at 210 nm.

For determination of specific ALS enzyme activity, culture samples were transferred into 50 ml centrifuge tubes (VWR, Radnor, Pa.) and centrifuged for 10 min at 5000 rpm and 4° C. in an Eppendorf 5804R centrifuge (Hamburg, Germany). Pellets were subsequently thawed, resuspended in 1.5 mL 0.1 M K-Hepes pH 6.8 containing 10 mM MgCl2, 0.5 mM TPP and a protease inhibitor cocktail (Roche, Catalog #11873580001), and then broken by bead beating with 0.5 mm glass beads. The broken cells were centrifuged to remove the cell debris and generate the yeast crude extract. Protein concentrations (mg/ml) of extracts were measured with the Pierce Coomassie Plus (Bradford) Protein Assay (Catalog #23236, Thermoscientific). ALS enzyme activities were measured spectrophotometrically in an end point assay using the method as described in W W Westerfeld (1945), J. Biol. Chem, 161, 495-502, with modifications. Usually activity was assayed at 4 time points. 10 µl 6 NH2SO4 was supplied in as many wells as needed. Additionally a standard curve from 0 to 50 nmol acetolactate was prepared. Extract and dilution buffer were combined to 400 µl in the reaction library tubes. Assay buffer consisted of 0.1 M K-Hepes pH 6.8, 10 mM MgCl2 and 0.5 mM TPP. Dilution buffer consisted of assay buffer and 0.5 mg/ml BSA. The reaction library tubes and a library strip of 0.25 M pyruvate in assay buffer were pre-warmed in a water bath. Reaction was started by adding 100 µl pyruvate solution to each reaction tube at timed intervals, mixing was accomplished by pipetting up and down.

100 µl samples were taken at 5, 10, 15, and 20 min into wells with sulfuric acid and again mixed by pipetting up and down. After all samples were collected, 100 µl acetolactate standards were added to the wells containing sulfuric acid. Plates were shaken briefly, covered with a lid and incubated in an oven at 50° C. for 30 min. Subsequently 100 µl of creatine-napthol solution was added to each well. Creatine-napthol solution was prepared by weighing out 1-napthol equivalent to 1.75 mg/well. 6 mg/ml creatine solution was added to make a 35 mg/ml napthol suspension. Just before use, an equal volume of 2.5 N NaOH was added and vortexed until solution was clear. Plate was incubated 30 min in oven at 50° C. and read at 530 nm with a Spectra Max384 Plus plate reader (Molecular Devices, Sunnyvale, Calif.).

Time course of OD and selected metabolites concentrations in the supernatant for strains PNY1623, PNY1624, PNY1625, PNY1626, PNY1627, PNY1559 and PNY1562 can be found in Tables 30-36. It can be seen that apart from the positive control of PNY1562, no other strain produces isobutanol under glucose-limited conditions with high oxygen availability. However, after addition of a glucose-bolus and significantly reduced oxygen supply due to high liquid volume in the shake flask and significant lower shaker speed, production of isobutanol was observed in all cultures apart from strain PNY1624 (Table 30-Table 36).

Average specific isobutanol production rates were determined in stage 1 growth phase of the experiment ranging from EPT=0 h to EPT=100.50 h under glucose-limited conditions with high oxygen supply and subsequently only slightly reduced oxygen supply, and for the stage 2 production phase of the experiment in the range of EPT=100.50 h to 148.5 h with glucose-excess conditions and reduced oxygen supply.

Average biomass concentration was determined by integration of the function of all the OD time points in stage 1 from EPT=0 h to EPT=100.50 h and assuming a linear connection between them, and subsequently dividing the result by the total time of the interval (100.50 h). Furthermore, an OD to cell dry weight (cdw) correlation of 0.33 g/l (cdw) per measured OD was assumed. It can be seen that none of the strains produces isobutanol in stage 1, but all strains with the exception of strain PNY1624 produces isobutanol in stage 2 (Table 30-Table 36).

Change in concentrations of selected pathway products (PP) in the isobutanol production pathway comprising KIV, DHX, isobutyric acid and isobutanol is depicted in Table 38. The entry reaction of the isobutanol biosynthesis pathway is catalyzed by acetolactate synthase (ALS). The first stage of the experiment (Δ26h, EPT=0-25.83 h) was characterized by glucose-limited conditions with high oxygen supply. The second stage (Δ75h, EPT=25.83-100.50 h) was characterized by glucose-limited conditions with slightly reduced oxygen supply. If combined, stage 1 and 2 are also referred to as phase 1 of the experiment. Phase 2 of the experiment (Δ24h, EPT=100.50-125 h, with measurements at EPT=101 h and EPT=125 h) exhibited glucose-excess conditions with reduced oxygen supply. It was found that in all cultures more pathway products are produced in stage 2 than in stage 1, and significantly more in phase 2 than in phase 1 (Table 37). It can be concluded that the flux through ALS is increased in strains PNY1623, PNY1625, PNY1626 and PNY1627 under phase 2 conditions.

Enzyme assays were carried out to assess enzymatic activity of acetolactate synthase (ALS) in the experiments. Results are depicted in Table 39.

TABLE 30

Optical density (OD) and concentrations of selected compounds in cultures of strain PNY1623.

PNY1623

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.046 | 0.0 | 0.0 | 0.0 | 0.0 | 0.0 | 88.0 | 1.1 | 0.0 | 0.0 | 0.0 |
| 4.00 | 0.118 | 0.0 | 0.6 | 0.0 | 0.0 | 0.0 | 88.9 | 0.9 | 0.0 | 0.0 | 0.0 |
| 20.50 | 1.217 | 0.0 | 0.0 | 0.0 | 0.0 | 0.0 | 86.1 | 0.0 | 0.0 | 0.0 | 0.0 |
| 25.83 | 1.657 | 0.0 | 0.0 | 0.3 | 0.0 | 0.0 | 84.7 | 0.0 | 0.1 | 0.0 | 0.2 |
| 28.50 | 1.887 | 0.0 | 0.0 | 0.2 | 0.0 | 0.0 | 84.9 | 0.0 | 0.1 | 0.0 | 0.2 |
| 44.33 | 2.767 | 0.0 | 0.0 | 0.2 | 0.0 | 0.1 | 82.4 | 0.0 | 0.2 | 0.0 | 0.3 |
| 49.83 | 2.757 | 0.0 | 0.0 | 0.1 | 0.0 | 0.1 | 81.5 | 0.0 | 0.2 | 0.0 | 0.4 |
| 100.50 | 4.117 | 0.0 | 0.0 | 0.1 | 0.1 | 0.3 | 77.4 | 0.0 | 0.4 | 0.0 | 0.8 |
| 101.00 | 3.247 | 275.2 | 0.0 | 0.0 | 0.3 | 0.2 | 61.0 | 0.0 | 0.3 | 0.0 | 0.8 |
| 125.00 | 3.437 | 258.4 | 10.5 | 17.2 | 0.6 | 0.8 | 66.5 | 2.6 | 0.6 | 0.6 | 2.6 |
| 148.50 | 3.257 | 248.9 | 13.8 | 23.3 | 0.7 | 1.1 | 68.5 | 5.7 | 0.7 | 0.8 | 3.4 |

DHX represents the sum of dihydroxyisovaleric acid (DHIV) and dihydroxymethylbutyric acid (DHMB) as determined by HPLC assuming equal response factors for both compounds.
PP denotes "pathway products" and represents the sum of concentrations of KIV, DHX, isobutyrate and isobutanol.
OD at EPT = 101 h was not measured but calculated from OD determined at EPT = 100.50 h and applying the same dilution factor as observed with the glycerol concentrations at this two time points

TABLE 31

Optical density (OD) and concentrations of selected compounds in cultures of strain PNY1624.

PNY1624

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.029 | 0.1 | 0.0 | 0.0 | 0.0 | 0.0 | 61.3 | 0.5 | 0.0 | 0.0 | 0.0 |
| 4.00 | 0.098 | 0.0 | 0.0 | 0.0 | 0.0 | 0.0 | 60.3 | 0.6 | 0.0 | 0.0 | 0.0 |
| 20.50 | 1.267 | 0.0 | 0.0 | 0.0 | 0.0 | 0.0 | 58.0 | 0.0 | 0.0 | 0.0 | 0.0 |
| 25.83 | 1.767 | 0.0 | 0.0 | 0.2 | 0.0 | 0.1 | 58.2 | 0.0 | 0.0 | 0.0 | 0.1 |
| 28.50 | 2.127 | 0.0 | 0.0 | 0.3 | 0.0 | 0.0 | 57.0 | 0.0 | 0.0 | 0,0 | 0.0 |

TABLE 31-continued

Optical density (OD) and concentrations of selected compounds in cultures of strain PNY1624.

PNY1624

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 44.33 | 3.297 | 0.0 | 0.0 | 0.1 | 0.0 | 0.3 | 55.3 | 0.0 | 0.0 | 0,0 | 0.3 |
| 49.83 | 3.577 | 0.0 | 0.0 | 0.0 | 0.1 | 0.4 | 54.7 | 0.0 | 0.0 | 0,0 | 0.5 |
| 100.50 | 4.917 | 0.0 | 0.0 | 0.0 | 0.1 | 0.8 | 50.6 | 0.0 | 0.0 | 0,0 | 0.9 |
| 101.00 | 3.947 | 286.1 | 0.0 | 0.1 | 0.3 | 0.6 | 40.6 | 0.0 | 0.0 | 0.0 | 0.8 |
| 125.00 | 3.917 | 276.2 | 0.0 | 14.2 | 0.8 | 1.4 | 42.6 | 0.7 | 0.0 | 0.0 | 2.3 |
| 148.50 | 3.677 | 274.4 | 0.0 | 20.1 | 1.2 | 1.9 | 43.2 | 0.3 | 0.0 | 0.0 | 3.1 |

DHX represents the sum of dihydroxyisovaleric acid (DHIV) and dihydroxymethylbutyric acid (DHMB) as determined by HPLC assuming equal response factors for both compounds.

PP denotes "pathway products" and represents the sum of concentrations of KIV, DHX, isobutyrate and isobutanol.

OD at EPT = 101 h was not measured but calculated from OD determined at EPT = 100.50 h and applying the same dilution factor as observed with the glycerol concentrations at this two time points

TABLE 32

Optical density (OD) and concentrations of selected compounds in cultures of strain PNY1625.

PNY1625

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.040 | 0.0 | 0.0 | 0.0 | 0.0 | 0.0 | 83.1 | 1.0 | 0.0 | 0.0 | 0.0 |
| 4.00 | 0.119 | 0.0 | 0.0 | 0.0 | 0.0 | 0.0 | 83.2 | 0.9 | 0.0 | 0.0 | 0.0 |
| 20.50 | 1.267 | 0.0 | 0.0 | 0.0 | 0.0 | 0.0 | 83.7 | 0.0 | 0.0 | 0.0 | 0.0 |
| 25.83 | 1.747 | 0.0 | 0.0 | 0.3 | 0.0 | 0.0 | 80.9 | 0.0 | 0.0 | 0.0 | 0.0 |
| 28.50 | 1.967 | 0.0 | 0.0 | 0.3 | 0.0 | 0.0 | 80.7 | 0.0 | 0.0 | 0.0 | 0.0 |
| 44.33 | 2.827 | 0.0 | 0.0 | 0.2 | 0.0 | 0.1 | 78.9 | 0.3 | 0.2 | 0.0 | 0.4 |
| 49.83 | 3.137 | 0.0 | 0.0 | 0.2 | 0.0 | 0.1 | 78.1 | 0.3 | 0.2 | 0.0 | 0.4 |
| 100.50 | 4.077 | 0.0 | 0.0 | 0.0 | 0.1 | 0.3 | 75.1 | 0.0 | 0.4 | 0.0 | 0.7 |
| 101.00 | 3.267 | 280.9 | 0.0 | 0.1 | 0.3 | 0.2 | 60.2 | 0.0 | 0.3 | 0.0 | 0.8 |
| 125.00 | 3.177 | 265.9 | 8.6 | 17.3 | 0.6 | 1.0 | 66.3 | 2.7 | 0.6 | 0.6 | 2.8 |
| 148.50 | 3.037 | 254.9 | 11.9 | 22.7 | 0.6 | 1.4 | 66.4 | 4.4 | 1.0 | 0.9 | 3.9 |

DHX represents the sum of dihydroxyisovaleric acid (DHIV) and dihydroxymethylbutyric acid (DHMB) as determined by HPLC assuming equal response factors for both compounds.

PP denotes "pathway products" and represents the sum of concentrations of KIV, DHX, isobutyrate and isobutanol.

OD at EPT = 101 h was not measured but calculated from OD determined at EPT = 100.50 h and applying the same dilution factor as observed with the glycerol concentrations at this two time points

TABLE 33

Optical density (OD) and concentrations of selected compounds in cultures of strain PNY1626.

PNY1626

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.054 | 0.0 | 0.0 | 0.0 | 0.0 | 0.0 | 84.7 | 1.0 | 0.0 | 0.0 | 0.0 |
| 4.00 | 0.139 | 0.0 | 0.0 | 0.0 | 0.0 | 0.0 | 84.5 | 0.7 | 0.0 | 0.0 | 0.0 |
| 20.50 | 1.287 | 0.0 | 0.0 | 0.0 | 0.0 | 0.1 | 83.4 | 0.0 | 0.0 | 0.0 | 0.1 |
| 25.83 | 1.727 | 0.0 | 0.0 | 0.1 | 0.0 | 0.3 | 82.5 | 0.0 | 0.2 | 0.0 | 0.4 |
| 28.50 | 1.897 | 0.0 | 0.0 | 0.1 | 0.0 | 0.4 | 82.4 | 0.0 | 0.2 | 0.0 | 0.5 |
| 44.33 | 2.647 | 0.0 | 0.0 | 0.1 | 0.0 | 0.8 | 80.5 | 0.2 | 0.3 | 0.0 | 1.1 |
| 49.83 | 3.017 | 0.0 | 0.0 | 0.1 | 0.0 | 0.9 | 79.9 | 0.0 | 0.4 | 0.0 | 1.3 |
| 100.50 | 4.117 | 0.0 | 0.0 | 0.0 | 0.1 | 1.5 | 76.4 | 0.0 | 0.6 | 0.0 | 2.2 |

TABLE 33-continued

Optical density (OD) and concentrations of selected compounds in cultures of strain PNY1626.

PNY1626

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 101.00 | 3.249 | 282.4 | 0.0 | 0.0 | 0.4 | 1.1 | 60.3 | 0.0 | 0.6 | 0.0 | 2.1 |
| 125.00 | 3.397 | 259.7 | 9.5 | 16.6 | 0.7 | 2.6 | 65.1 | 2.5 | 0.7 | 1.0 | 4.9 |
| 148.50 | 3.217 | 248.0 | 11.7 | 22.9 | 0.7 | 3.8 | 67.0 | 5.5 | 1.3 | 1.6 | 7.3 |

DHX represents the sum of dihydroxyisovaleric acid (DHIV) and dihydroxymethylbutyric acid (DHMB) as determined by HPLC assuming equal response factors for both compounds.
PP denotes "pathway products" and represents the sum of concentrations of KIV, DHX, isobutyrate and isobutanol.
OD at EPT = 101 h was not measured but calculated from OD determined at EPT = 100.50 h and applying the same dilution factor as observed with the glycerol concentrations at this two time points

TABLE 34

Optical density (OD) and concentrations of selected compounds in cultures of strain PNY1627.

PNY1627

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.049 | 0.0 | 0.0 | 0.0 | 0.0 | 0.0 | 82.9 | 1.0 | 0.0 | 0.0 | 0.0 |
| 4.00 | 0.119 | 0.0 | 0.0 | 0.0 | 0.0 | 0.0 | 83.0 | 0.7 | 0.0 | 0.0 | 0.0 |
| 20.50 | 1.197 | 0.0 | 0.0 | 0.0 | 0.0 | 0.0 | 82.6 | 0.0 | 0.0 | 0.0 | 0.0 |
| 25.83 | 1.707 | 0.0 | 0.0 | 0.2 | 0.0 | 0.0 | 81.0 | 0.0 | 0.1 | 0.0 | 0.2 |
| 28.50 | 1.927 | 0.0 | 0.0 | 0.2 | 0.0 | 0.0 | 80.8 | 0.0 | 0.1 | 0.0 | 0.1 |
| 44.33 | 2.917 | 0.0 | 0.0 | 0.1 | 0.0 | 0.1 | 78.7 | 0.0 | 0.2 | 0.0 | 0.4 |
| 49.83 | 2.957 | 0.0 | 0.0 | 0.1 | 0.0 | 0.1 | 78.2 | 0.0 | 0.2 | 0.0 | 0.4 |
| 100.50 | 4.217 | 0.0 | 0.0 | 0.0 | 0.1 | 0.3 | 73.3 | 0.0 | 0.3 | 0.0 | 0.7 |
| 101.00 | 3.415 | 279.2 | 0.0 | 0.0 | 0.2 | 0.2 | 59.4 | 0.0 | 0.3 | 0.0 | 0.7 |
| 125.00 | 3.497 | 260.0 | 9.1 | 17.3 | 0.6 | 0.7 | 64.0 | 2.6 | 0.4 | 0.5 | 2.3 |
| 148.50 | 3.357 | 252.2 | 12.1 | 23.5 | 0.7 | 1.1 | 65.9 | 5.4 | 0.7 | 0.8 | 3.3 |

DHX represents the sum of dihydroxyisovaletic acid (DHIV) and dihydroxymethylbutyric acid (DHMB) as determined by HPLC assuming equal response factors for both compounds.
PP denotes "pathway products" and represents the sum of concentrations of KIV, DHX, isobutyrate and isobutanol.
N.a. = not analyzed.
OD at EPT = 101 h was not measured but calculated from OD determined at EPT = 100.50 h and applying the same dilution factor as observed with the glycerol concentrations at this two time points.

TABLE 35

Optical density (OD) and concentrations of selected compounds in cultures of strain PNY1559.

PNY1559

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.028 | 0.0 | 0.0 | 0.0 | 0.0 | 0.0 | 58.3 | 0.8 | 0.0 | 0.0 | 0.0 |
| 4.00 | 0.097 | 0.1 | 0.0 | 0.0 | 0.0 | 0.1 | 57.4 | 0.5 | 0.0 | 0.0 | 0.1 |
| 20.50 | 1.137 | 0.0 | 0.0 | 0.0 | 0.0 | 0.0 | 57.2 | 0.0 | 0.0 | 0.0 | 0.0 |
| 25.83 | 1.517 | 0.0 | 0.0 | 0.1 | 0.0 | 0.0 | 56.4 | 0.0 | 0.1 | 0.0 | 0.1 |
| 28.50 | 1.757 | 0.0 | 0.0 | 0.1 | 0.0 | 0.0 | 56.3 | 0.0 | 0.1 | 0.0 | 0.1 |
| 44.33 | 2.587 | 0.0 | 0.0 | 0.0 | 0.0 | 0.1 | 54.9 | 0.0 | 0.2 | 0.0 | 0.2 |
| 49.83 | 2.897 | 0.0 | 0.0 | 0.0 | 0.0 | 0.1 | 54.5 | 0.0 | 0.2 | 0.0 | 0.4 |
| 100.50 | 3.857 | 0.0 | 0.0 |  | 0.1 | 0.3 | 51.1 | 0.0 | 0.3 | 0.0 | 0.6 |
| 101.00 | 3.075 | 281.8 | 0.0 | 0.0 | 0.0 | 0.2 | 40.7 | 0.0 | 0.2 | 0.0 | 0.4 |
| 125.00 | 3.297 | 252.1 | 12.1 | 18.0 | 0.6 | 0.7 | 43.9 | 2.6 | 0.4 | 0.6 | 2.3 |
| 148.50 | 3.197 | 247.5 | 17.1 | 24.8 | 0.6 | 1.1 | 46.9 | 5.0 | 0.6 | 0.9 | 3.2 |

DHX represents the sum of dihydroxyisovaleric acid (DHIV) and dihydroxymethylbutyric acid (DHMB) as determined by HPLC assuming equal response factors for both compounds.
PP denotes "pathway products" and represents the sum of concentrations of KIV, DHX, isobutyrate and isobutanol.
OD at EPT = 101 h was not measured but calculated from OD determined at EPT = 100.50 h and applying the same dilution factor as observed with the glycerol concentrations at this two time points

TABLE 36

Optical density (OD) and concentrations of selected compounds in cultures of strain PNY1559.
PNY1562

| EPT [h] | OD [ ] | glucose [mM] | ethanol [mM] | pyruvate [mM] | KIV [mM] | DHX [mM] | glycerol [mM] | acetate [mM] | isobutyrate [mM] | isobutanol [mM] | PP [mM] |
|---|---|---|---|---|---|---|---|---|---|---|---|
| 0.00 | 0.029 | 0.0 | 0.0 | 0.0 | 0.0 | 0.0 | 57.6 | 0.8 | 0.0 | 0.0 | 0.0 |
| 4.00 | 0.102 | 0.1 | 0.0 | 0.0 | 0.0 | 0.0 | 58.7 | 0.6 | 0.0 | 0.0 | 0.0 |
| 20.50 | 0.557 | 0.0 | 0.0 | 0.0 | 0.0 | 0.4 | 57.4 | 0.0 | 0.3 | 0.0 | 0.8 |
| 25.83 | 0.707 | 0.0 | 0.0 | 0.0 | 0.0 | 0.6 | 57.5 | 0.0 | 0.6 | 0.0 | 1.3 |
| 28.50 | 0.837 | 0.0 | 0.0 | 0.0 | 0.0 | 0.7 | 57.7 | 0.0 | 0.7 | 0.0 | 1.5 |
| 44.33 | 1.437 | 0.0 | 0.0 | 0.0 | 0.1 | 1.1 | 56.3 | 0.0 | 1.2 | 0.0 | 2.4 |
| 49.83 | 1.637 | 0.0 | 0.0 | 0.0 | 0.1 | 1.3 | 55.8 | 0.0 | 1.5 | 0.0 | 2.9 |
| 100.50 | 2.877 | 0.0 | 0.0 | 0.0 | 0.1 | 3.0 | 50.9 | 0.0 | 2.9 | 0.0 | 6.1 |
| 101.00 | 2.313 | 284.9 | 0.0 | 0.0 | 0.0 | 2.4 | 40.9 | 0.0 | 2.3 | 0.0 | 4.6 |
| 125.00 | 2.457 | 245.3 | 0.0 | 0.1 | 1.4 | 8.5 | 48.8 | 0.5 | 8.0 | 13.1 | 31.0 |
| 148.50 | 2.437 | 218.1 | 1.8 | 0.5 | 1.6 | 11.7 | 52.0 | 2.1 | 12.7 | 17.3 | 43.3 |

DHX represents the sum of dihydroxyisovaleric acid (DHIV) and dihydroxymethylbutyric acid (DHMB) as determined by HPLC assuming equal response factors for both compounds.
PP denotes "pathway products" and represents the sum of concentrations of KIV, DHX, isobutyrate and isobutanol.
OD at EPT = 101 h was not measured but calculated from OD determined at EPT = 100.50 h and applying the same dilution factor as observed with the glycerol concentrations at this two time points

TABLE 37

Specific isobutanol production in phase 1 (S1) of the experiment under glucose-limited and oxygen-sufficient conditions or with only slightly reduced oxygen supply, q(iso) S(1), as compared to the specific isobutanol production rates in phase 2, q(iso) (S2), under glucose-excess conditions with reduced oxygen supply

| | q (iso) (S1) [mmol/g h] | q (iso) (S2) [mmol/g h] |
|---|---|---|
| PNY1623 | 0.000 | 0.022 |
| PNY1624 | 0.000 | 0.000 |
| PNY1625 | 0.000 | 0.025 |
| PNY1626 | 0.000 | 0.038 |
| PNY1627 | 0.000 | 0.019 |
| PNY1559 | 0.000 | 0.023 |
| PNY1562 | 0.000 | 0.708 |

TABLE 38

Change in the concentration of selected pathway products (PP) in the isobutanol production pathway comprising KIV, DHX, isobutyric acid and isobutanol. The entry reaction of the isobutanol biosynthesis pathway is catalyzed by acetolactate synthase (ALS). The first stage of the experiment ($\Delta 26$ h, EPT = 0-25.83 h) was characterized by glucose-limited conditions with high oxygen supply. The second stage ($\Delta 75$ h, EPT = 25.83-100.50 h) was characterized by glucose-limited conditions with slightly reduced oxygen supply. Combined, stage 1 and 2 are also referred to as phase 1 of the experiment. Phase 2 of the experiment ($\Delta 24$ h, EPT = 100.50-125 h, with measurements at EPT = 101 h and EPT = 125 h) exhibited glucose-excess conditions with reduced oxygen supply

| | c (PP) | | |
|---|---|---|---|
| | $\Delta 26$ h [mM] | $\Delta 75$ h [mM] | $\Delta 24$ h [mM] |
| PNY1623 | 0.159 | 0.607 | 1.782 |
| PNY1624 | 0.126 | 0.819 | 1.434 |
| PNY1625 | 0.041 | 0.659 | 2.032 |
| PNY1626 | 0.413 | 1.780 | 2.840 |
| PNY1627 | 0.158 | 0.535 | 1.624 |
| PNY1559 | 0.100 | 0.520 | 1.864 |
| PNY1562 | 1.283 | 4.797 | 26.343 |

TABLE 39

Specific enzyme activities measured in units per mg of protein in crude cell extract

| | Strain | | | | | | |
|---|---|---|---|---|---|---|---|
| EPT [h] | PNY1624 SA [U/mg] | PNY1625 SA [U/mg] | PNY1623 SA [U/mg] | PNY1626 SA [U/mg] | PNY1627 SA [U/mg] | PNY1559 SA [U/mg] | PNY1562 SA [U/mg] |
| 20.50 | −0.01 | 0.00 | 0.00 | −0.02 | −0.01 | 0.01 | 0.44 |
| 25.83 | −0.02 | 0.00 | −0.02 | 0.03 | 0.00 | 0.00 | 0.55 |
| 44.33 | −0.01 | 0.00 | 0.00 | 0.01 | −0.03 | 0.00 | 0.46 |
| 49.83 | 0.00 | 0.01 | −0.01 | 0.00 | 0.00 | 0.01 | 0.54 |
| 100.50 | 0.02 | 0.00 | 0.00 | 0.01 | 0.00 | 0.00 | 0.69 |
| 125.00 | −0.06 | −0.01 | −0.01 | 0.01 | 0.00 | 0.00 | 0.57 |
| 148.50 | −0.22 | 0.02 | 0.07 | 0.00 | −0.05 | 0.02 | 1.24 |

SEQUENCE LISTING (834 sequences)

SEQ ID NO: 1 - protein, 571 aa, Bacillus subtilis
MLTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 2 - DNA, 1716 bp, Bacillus subtilis
atgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctag

SEQ ID NO: 3 - protein, 559 aa, Klebsiella pneumoniae
MDKQYPVRQWAHGADLVVSQLEAQGVRQVFGIPGAKIDKVFDSLLDSSIRIIPVRHEANAAFMAAAVGRITGKAGVALVTSGPGCSNLITGMATANSEGDPVVALGGAVKRADKAKQVHQSMDTVAMFSPVTKYAIEVTAPDALAEVVSNAFRAAEQGRPGSAFVSLPQDVVDGPVSGKVLPASGAPQMGAAPDDAIDQVAKLIAQAKNPIFLLGLMASQPENSKALRRLLETSHIPVTSTYQAAGAVNQDNFSRFAGRVGLFNNQAGDRLLQLADLVICIGYSPVEYEPAMWNSGNATLVHIDVLPAYEERNYTPDVELVGDIAGTLNKLAQNIDHRLVLSPQAAEILRDRQHQRELLDRRGAQLNQFALHPLRIVRAMQDIVNSDVTLTVDMGSFHIWIARYLYTFRARQVMISNGQQTMGVALPWAIGAWLVNPERKVVSVSGDGGFLQSSMELETAVRLKANVLHLIWVDNGYNMVAIQEEKKYQRLSGVEFGPMDFKAYAESFGAKGFAVESAEALEPTLRAAMDVDGPAVVAIPVDYRDNPLLMGQLHLSQIL

SEQ ID NO: 4 - DNA, 2055 bp, Klebsiella pneumoniae
tcgaccacggggtgctgaccttcggcgaaattcacaagctgatgatcgacctgcccgccgacagcgcgttcctgcaggctaatctgcatcccgataatctcgatgccgccatccgttccgtagaaagttaagggggtcacatggacaaacagtatccggtacgccagtgggcgcacggcgccgatctcgtcgtcagtcagctggaagctcagggagtacgccaggtgttcggcatccccggcgccaaaatcgacaaggtctttgattcactgctggattcctccattcgcattattccggtacgccacgaagccaacgccgcatttatggccgccgccgtcggacgcattaccggcaaagcgggcgtggcgctggtcacctccggtccgggctgttccaacctgatcaccggcatggccaccgcgaacagcgaaggcgacccggtggtggccctgggcggcgcggtaaaacgcgccgataaagcgaagcaggtccaccagagtatggatacggtggcgatgttcagcccggtcaccaaatacgccatcgaggtgacggcgccggatgcgctggcggaagtggtctccaacgccttccgcgccgccgagcagggccggccgggcagcgcgttcgttagcctgccgcaggatgtggtcgatggcccggtcagcggcaaagtgctgccggccagcggggccccgcagatgggcgccgcgccggatgatgccatcgaccaggtggcgaagcttatcgcccaggcgaagaacccgatcttcctgctcggcctgatggccagccagccggaaaacagcaaggcgctgcgccgtttgctggagaccagccatattccagtcaccagcacctatcaggccgccggagcggtgaatcaggataacttctctcgcttcgccggccgggttgggctgtttaacaaccaggccggggaccgtctgctgcagctcgccgacctggtgatctgcatcggctacagcccggtggaatacgaaccggcgatgtggaacagcggcaacgcgacgctggtgcacatcgacgtgctgcccgcctatgaagagcgcaactacaccccggatgtcgagctggtgggcgatatcgccggcactctcaacaagctggcgcaaaatatcgatcatcggctggtgctctccccgcaggcggcggagatcctccgcgaccgccagcaccagcgcgagctgctggaccgccgcggcgcgcagctcaaccagtttgccctgcatcccctgcgcatcgttcgcgccatgcaggatatcgtcaacagcgacgtcacgttgaccgtggacatgggcagcttccatatctggattgcccgctacctgtacacgttccgcgcccgtcaggtgatgatctccaacggccagcagaccatgggcgtcgccctgccctgggctatcggcgcctggctggtcaatcctgagcgcaaagtggtctccgtctccggcgacggcggcttcctgcagtcgagcatggagctggagaccgccgtccgcctgaaagccaacgtgctgcatcttatctgggtcgataacggctacaacatggtcgctatccaggaagagaaaaaatatcagcgcctgtccggcgtcgagtttgggccgatggattttaaagcctatgccgaatccttcggcgcgaaagggtttgccgtggaaagcgccgaggcgctggagccgaccctgcgcgcggcgatggacgtcgacggcccggcggtagtggccatcccggtggattatcgcgataacccgctgctgatgggccagctgcatctgagtcagattctgtaagtcatcacaataaggaaagaaaaatgaaaaaagtcgcacttgttaccggcgccggccaggggattggtaaagctatcgcccttcgtctggtgaaggatggatttgccgtggccattgccgattataacgacgccaccgccaaagcggtcgcctccgaaatcaaccaggccggcggccgcgccatggcggtgaaagtggatgtttctgaccgcgaccaggtatttgccgccgtcga

SEQ ID NO: 5 - protein, 554 aa, Lactococcus lactis
MSEKQFGANLVVDSLINHKVKYVFGIPGAKIDRVFDLLENEEGPQMVVTRHEQGAAFMAQAVGRLTGEPGVVVVTSGPGVSNLATPLLTATSEGDAILAIGGQVKRSDRLKRAHQSMDNAGMMQSATKYSAEVLDPNTLSESIANAYRIAKSGHPGATFLSIPQDVTDAEVSIKAIQPLSDPKMGNASIDDINYLAQAIKNAVLPVILVGAGASDAKVASSLRNLLTHVNIPVVETFQGAGVISHDLEHTFYGRIGLFRNQPGDMLLKRSDLVIAVGYDPIEYEARNWNAEIDSRIIVIDNAIAEIDTYYQPERELIGDIAATLDNLLPAVRGYKIPKGTKDYLDGLHEVAEQHEFDTENTEEGRMHPLDLVSTFQEIVKDDETVTVDVGSLYIWMARHFKSYEPRHLLFSNGMQTLGVALPWAITAALLRPGKKVYSHSGDGGFLFTGQELETAVRLNLPIVQIIWNDGHYDMVKFQEEMKYGRSAAVDFGYVDYVKYAEAMRAKGYRAHSKEELAEILKSIPDTTGPVVIDVPLDYSDNIKLAEKLLPEEFY

SEQ ID NO: 6 - DNA, 3220 bp, Lactococcus lactis
tagatccggaaacaactgattacctgagttaacttagcagaaattgcagaagataacggtaatttggatgaagcattaaattacctttatcaaattccggtgaatgatgaaaattatattgctgctttaatcaaaattgctgacttatatcaatttgaagttgattttgaaacagcaatttctaagttagaagaagcaagagaattatcggattctcctctgattacttttgctttggctgagtcctactttgaacaaggtgattattcagctgccattaccgaatatgcaaaactttcagaacgaaaaattttacatgaaacaaaaatttctatttatcaaagaattggtgactcttatgcccaattaggtaattttgagaatgccatatcatttcttgaaaaatcacttgaatttgatgaaaaaccggaaaccttgtataaaattgctcttctttatggagaaactcataatgaaacaagagccattgctaatttcaaacggttagaaaaaatggatgttgaatttttgaactatgaattagcctatgcccaaaccctagaagctaatcaagaatttaaagctgcactagaaatggcaaagaaagggatgaaaaaaaatcctaatgccgttcctctcttacacttcgcttcaaaaatttgtttcaaacttaaggacaaagctgcagcagaacgttatctcgtggatgctttaaatttaccagaattacatgacgaaacagtctttttgcttgctaatttatacttcaacgaagaagattttgaagctgtcattaatcttgaagagcttttagaagatgaacatttattagctaaatggctttttgcaggagcacataaagctttggaaaatgattctgaagcggctgctttgtatgaagaactcattcaaaccaatctgtcagagaatccagagtttttagaagactatattgattttcttaaagaaattggtcaaatttctaaaacagaaccaattattgaacaatatttggaacttgttccagatgatgaaaatatgagaaatttactgacagacttaaaaaataattactgacaaagctgtcagtaattatttttattgtaagctagaaaattcaaaaacttgcgtcaaaataattgtaaaaggttctattatctgataaaatgattgtgaagtaatccaagagattatgaaatatgaattagaacaaatagaggtaaaataaaaaatgtctgagaaacaatttggggcgaacttggttgtcgatagtttgattaaccataaagtgaagtatgtatttgggattccaggagcaaaaattgaccgggtttttgatttattagaaaatgaagaaggccctcaaatggtcgtgactcgtcatgagcaaggagctgctttcatggctcaagctgtcggtcgtttaactggcgaacctggtgtagtagttgttacgagtgggcctggtgtatcaaaccttgcgactccgcttttgaccgcgacatcagaaggtgatgctattttggctatcggtggacaagttaaacgaagtgaccgtcttaaacgtgcgcaccaatcaatggataatgctggaatgatgcaatcagcaacaaaatattcagcagaagttcttgaccctaatacactttctgaatcaattgccaacgcttatcgtattgcaaaatcaggacatccaggtgcaactttcttatcaatcccccaagatgtaacggatgccgaagtatcaatcaaagccattcaaccactttcagaccctaaaatggggaatgcctctattgatgacattaattatttagcacaagcaattaaaaatgctgtattgccagtaattttggttggagctggtgcttcagatgctaaagtcgcttcatccttgcgtaatctattgactcatgttaatattcctgtcgttgaaacattccaaggtgcaggggttatttcacatgatttagaacatactttttatggacgtatcggtcttttccgcaatcaaccaggcgatatgcttctgaaacgttctgaccttgttattgctgttggttatgacccaattgaatatgaagctcgtaactggaatgcagaaattgatagtcgaattatcgttattgataatgccattgctgaaattgatacttactaccaaccagagcgtgaattaattggtgatatcgcagcaacattggataatcttttaccagctgttcgtggctacaaaattccaaaaggaacaaaagattatctcgatggccttcatgaagttgctgagcaacacgaatttgatactgaaaatactgaagaaggtagaatgcaccctcttgatttggtcagcactttccaagaaatcgtcaaggatgatgaaacagtaaccgttgacgtaggttcactctacatttggatggcacgtcatttcaaatcatacgaaccacgtcatctcctcttctcaaacggaatgcaaacactcggagttgcacttccttgggcaattacagccgcattgttgcgcccaggtaaaaaagtttattcacactctggtgatggaggcttccttttcacagggcaagaattggaaacagctgtacgtttgaatcttccaatcgttcaaattatctggaatgacggccattatgatatggttaaattccaagaagaaatgaaatatggtcgttcagcagccgttgattttggctatgttgattacgtaaaatatgctgaagcaatgagagcaaaaggttaccgtgcacacagcaaagaagaacttgctgaaattctcaaatcaatcccagatactactggaccggtggtaattgacgttcctttggactattctgataacattaaattagcagaaaaattattgcctgaagagttttattgattacaatcaagcaatttgtggcataacaaaataaaagaagaaggccttgaacacctaagcgttcagggcctttttttgtgaaataaattagatgaaatttacaatgagttttgtgaaactagcttctagtttgtgaaaaattgcctataattgccgaataaaaatacccatttaccactccaagaggatgcttcaaattagctaaatacccgttttagaggatgcgtaaaaacaacaaaagaggatgagtatagaacgataaaacttttttatgataggttgagagaattgaatataaaatataataagtagaaggcagcaatt

SEQ ID NO: 7 - protein, 491 aa, Escherichia coli
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 8 - protein, 1476 aa, Escherichia coli
ATGGCTAACTACTTCAATACACTGAATCTGCGCCAGCAGCTGGCACAGCTGGGCAAATGTCGCTTTATGGGCCGCGATGAATTCGCCGATGGCGCGAGCTACCTTCAGGGTAAAAAAGTAGTCATCGTCGGCTGTGGCGCACAGGGTCTGAACCAGGGCCTGAACATGCGTGATTCTGGTCTCGATATCTCCTACGCTCTGCGTAAAGAAGCGATTGCCGAGAAGCGCGCGTCCTGGCGTAAAGCGACCGAAAATGGTTTTAAAGTGGGTACTTACGAAGAACTGATCCCACAGGCGGATCTGGTGATTAACCTGACGCCGGACAAGCAGCACTCTGATGTAGTGCGCACCGTACAGCCACTGATGAAAGACGGCGCGGCGCTGGGCTACTCGCACGGTTTCAACATCGTCGAAGTGGGCGAGCAGATCCGTAAAGATATCACCGTAGTGATGGTTGCGCCGAAATGCCCAGGCACCGAAGTGCGTGAAGAGTACAAACGTGGGTTCGGCGTACCGACGCTGATTGCCGTTCACCCGGAAAACGATCCGAAAGGCGAAGGCATGGCGATTGCCAAAGCCTGGGCGGCTGCAACCGGTGGTCACCGTGCGGGTGTGCTGGAATCGTCCTTCGTTGCGGAAGTGAAATCTGACCTGATGGGCGAGCAAACCATCCTGTGCGGTATGTTGCAGGCTGGCTCTCTGCTGTGCTTCGACAAGCTGGTGGAAGAAGGTACCGATCCAGCATACGCAGAAAAACTGATTCAGTTCGGTTGGGAAACCATCACCGAAGCACTGAAACAGGGCGGCATCACCCTGATGATGGACCGTCTCTCTAACCCGGCGAAACTGCGTGCTTATGCGCTTTCTGAACAGCTGAAAGAGATCATGGCACCCCTGTTCCAGAAACATATGGACGACATCATCTCCGGCGAATTCTCTTCCGGTATGATGGCGGACTGGGCCAACGATGATAAGAAACTGCTGACCTGGCGTGAAGAGACCGGCAAAACCGCGTTTGAAACCGCGCCGCAGTATGAAGGCAAAATCGGCGAGCAGGAGTACTTCGATAAAGGCGTACTGATGATTGCGATGGTGAAAGCGGGCGTTGAACTGGCGTTCGAAACCATGGTCGATTCCGGCATCATTGAAGAGTCTGCATATTATGAATCACTGCACGAGCTGCCGCTGATTGCCAACACCATCGCCCGTAAGCGTCTGTACGAAATGAACGTGGTTATCTCTGATACCGCTGAGTACGGTAACTATCTGTTCTCTTACGCTTGTGTGCCGTTGCTGAAACCGTTTATGGCAGAGCTGCAACCGGGCGACCTGGGTAAAGCTATTCCGGAAGGCGCGGTAGATAACGGGCAACTGCGTGATGTGAACGAAGCGATTCGCAGCCATGCGATTGAGCAGGTAGGTAAGAAACTGCGCGGCTATATGACAGATATGAAACGTATTGCTGTTGCGGGTTAA

SEQ ID NO: 9 - protein, 395 aa, Saccharomyces cerevisiae
MLRTQAARLICNSRVITAKRTFALATRAAAYSRPAARFVKPMITTRGLKQINFGGTVETVYERADWPREKLLDYFKNDTFALIGYGSQGYGQGLNLRDNGLNVIIGVRKDGASWKAAIEDGWVPGKNLFTVEDAIKRGSYVMNLLSDAAQSETWPAIKPLLTKGKTLYFSHGFSPVFKDLTHVEPPKDLDVILVAPKGSGRTVRSLFKEGRGINSSYAVWNDVTGKAHEKAQALAVAIGSGYVYQTTFEREVNSDLYGERGCLMGGIHGMFLAQYDVLRENGHSPSEAFNETVEEATQSLYPLIGKYGMDYMYDACSTTARRGALDWYPIFKNALKPVFQDLYESTKNGTETKRSLEFNSQPDYREKLEKELDTIRNMEIWKVGKEVRKLRPENQ

SEQ ID NO: 10 - protein, 1188 aa, Saccharomyces cerevisiae
ATGTTGAGAACTCAAGCCGCCAGATTGATCTGCAACTCCCGTGTCATCACTGCTAAGAGAACCTTTGCTTTGGCCACCCGTGCTGCTGCTTACAGCAGACCAGCTGCCCGTTTCGTTAAGCCAATGATCACTACCCGTGGTTTGAAGCAAATCAACTTCGGTGGTACTGTTGAAACCGTCTACGAAAGAGCTGACTGGCCAAGAGAAAAGTTGTTGGACTACTTCAAGAACGACACTTTTGCTTTGATCGGTTACGGTTCCCAAGGTTACGGTCAAGGTTTGAACTTGAGAGACAACGGTTTGAACGTTATCATTGGTGTCCGTAAAGATGGTGCTTCTTGGAAGGCTGCCATCGAAGACGGTTGGGTTCCAGGCAAGAACTTGTTCACTGTTGAAGATGCTATCAAGAGAGGTAGTTACGTTATGAACTTGTTGTCCGATGCCGCTCAATCAGAAACCTGGCCTGCTATCAAGCCATTGTTGACCAAGGGTAAGACTTTGTACTTCTCCCACGGTTTCTCCCCAGTCTTCAAGGACTTGACTCACGTTGAACCACCAAAGGACTTAGATGTTATCTTGGTTGCTCCAAAGGGTTCCGGTAGAACTGTCAGATCTTTGTTCAAGGAAGGTCGTGGTATTAACTCTTCTTACGCCGTCTGGAACGATGTCACCGGTAAGGCTCACGAAAAGGCCCAAGCTTTGGCCGTTGCCATTGGTTCCGGTTACGTTTACCAAACCACTTTCGAAAGAGAAGTCAACTCTGACTTGTACGGTGAAAGAGGTTGTTTAATGGGTGGTATCCACGGTATGTTCTTGGCTCAATACGACGTCTTGAGAGAAAACGGTCACTCCCCATCTGAAGCTTTCAACGAAACCGTCGAAGAAGCTACCCAATCTCTATACCCATTGATCGGTAAGTACGGTATGGATTACATGTACGATGCTTGTTCCACCACCGCCAGAAGAGGTGCTTTGGACTGGTACCCAATCTTCAAGAATGCTTTGAAGCCTGTTTTCCAAGACTTGTACGAATCTACCAAGAACGGTACCGAAACCAAGAGATCTTTGGAATTCAACTCTCAACCTGACTACAGAGAAAAGCTAGAAAAGGAATTAGACACCATCAGAAACATGGAAATCTGGAAGGTTGGTAAGGAAGTCAGAAAGTTGAGACCAGAAAACCAATAA

SEQ ID NO: 11 - protein, 330 aa, Methanococcus maripaludis
MKVFYDSDFKLDALKEKTIAVIGYGSQGRAQSLNMKDSGLNVVVGLRKNGASWNNAKADGHNVMTIEEAAEKADIIHILIPDELQAEVYESQIKPYLKEGKTLSFSHGFNIHYGFIVPPKGVNVVLVAPKSPGKMVRRTYEEGFGVPGLICIEIDATNNAFDIVSAMAKGIGLSRAGVIQTTFKEETETDLFGEQAVLCGGVTELIKAGFETLVEAGYAPEMAYFETCHELKLIVDLIYQKGFKNMWNDVSNTAEYGGLTRRSRIVTADSKAAMKEILREIQDGRFTKEFLLEKQVSYAHLKSMRRLEGDLQIEEVGAKLRKMCGLEKEE

SEQ ID NO: 12 - DNA, 993 bp, Methanococcus maripaludis
atgaaggtattctatgactcagattttaaattagatgctttaaaagaaaaaacaattgcagtaatcggttatggaagtcaaggtagggcacagtccttaaacatgaaagacagcggattaaacgttgttgttggtttaagaaaaaacggtgcttcatggaacaacgctaaagcagacggtcacaatgtaatgaccattgaagaagctgctgaaaaagcggacatcatccacatcttaatacctgatgaattacaggcagaagtttatgaaagccagataaaaccatacctaaaagaaggaaaaacactaagcttttcacatggttttaacatccactatggattcattgttccaccaaaaggagttaacgtggttttagttgctccaaaatcacctggaaaaatggttagaagaacatacgaagaaggtttcggtgttccaggtttaatctgtattgaaattgatgcaacaaacaacgcatttgatattgtttcagcaatggcaaaaggaatcggtttatcaagagctggagttatccagacaactttcaaagaagaaacagaaactgaccttttcggtgaacaagctgttttatgcggtggagttaccgaattaatcaaggcaggatttgaaacactcgttgaagcaggatacgcaccagaaatggcatactttgaaacctgccacgaattgaaattaatcgttgacttaatctaccaaaaaggattcaaaaacatgtggaacgatgtaagtaacactgcagaatacggcggacttacaagaagaagcagaatcgttacagctgattcaaaagctgcaatgaaagaaatcttaagagaaatccaagatggaagattcacaaaagaattccttctcgaaaaacaggtaagctatgctcatttaaaatcaatgagaagactcgaaggagacttacaaatcgaagaagtcggcgcaaaattaagaaaaatgtgcggtcttgaaaaagaagaataa

SEQ ID NO: 13 - protein, 342 aa, Bacillus subtilis
MVKVYYNGDIKENVLAGKTVAVIGYGSQGHAHALNLKESGVDVIVGVRQGKSFTQAQEDGHKVFSVKEAAAQAEIIMVLLPDEQQQKVYEAEIKDELTAGKSLVFAHGFNVHFHQIVPPADVDVFLVAPKGPGHLVRRTYEQGAGVPALFAIYQDVTGEARDKALAYAKGIGGARAGVLETTFKEETETDLFGEQAVLCGGLSALVKAGFETLTEAGYQPELAYFECLHELKLIVDLMYEEGLAGMRYSISDTAQWGDFVSGPRVVDAKVKESMKEVLKDIQNGTFAKEWIVENQVNRPRFNAINASENEHQIEVVGRKLREMMPFVKQGKKKEAVVSVAQN

SEQ ID NO: 14 - protein, 1476 aa, Bacillus subtilis; identical to SEQ ID NO: 8

SEQ ID NO: 15 - protein, 616 aa, Escherichia coli
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 16 - protein, 1851 aa, Escherichia coli
ATGCCTAAGTACCGTTCCGCCACCACCACTCATGGTCGTAATATGGCGGGTGCTCGTGCGCTGTGGCGCGCCACCGGAATGACCGACGCCGATTTCGGTAAGCCGATTATCGCGGTTGTGAACTCGTTCACCCAATTTGTACCGGGTCACGTCCATCTGCGCGATCTCGGTAAACTGGTCGCCGAACAAATTGAAGCGGCTGGCGGCGTTGCCAAAGAGTTCAACACCATTGCGGTGGATGATGGGATTGCCATGGGCCACGGGGGGATGCTTTATTCACTGCCATCTCGCGAACTGATCGCTGATTCCGTTGAGTATATGGTCAACGCCCACTGCGCCGACGCCATGGTCTGCATCTCTAACTGCGACAAAATCACCCCGGGGATGCTGATGGCTTCCCTGCGCCTGAATATTCCGGTGATCTTTGTTTCCGGCGGCCCGATGGAGGCCGGGAAAACCAAACTTTCCGATCAGATCATCAAGCTCGATCTGGTTGATGCGATGATCCAGGGCGCAGACCCGAAAGTATCTGACTCCCAGAGCGATCAGGTTGAACGTTCCGCGTGTCCGACCTGCGGTTCCTGCTCCGGGATGTTTACCGCTAACTCAATGAACTGCCTGACCGAAGCGCTGGGCCTGTCGCAGCCGGGCAACGGCTCGCTGCTGGCAACCCACGCCGACCGTAAGCAGCTGTTCCTTAATGCTGGTAAACGCATTGTTGAATTGACCAAACGTTATTACGAGCAAAACGACGAAAGTGCACTGCCGCGTAATATCGCCAGTAAGGCGGCGTTTGAAAACGCCATGACGCTGGATATCGCGATGGGTGGATCGACTAACACCGTACTTCACCTGCTGGCGGCGGCGCAGGAAGCGGAAATCGACTTCACCATGAGTGATATCGATAAGCTTTCCCGCAAGGTTCCACAGCTGTGTAAAGTTGCGCCGAGCACCCAGAAATACCATATGGAAGATGTTCACCGTGCTGGTGGTGTTATCGGTATTCTCGGCGAACTGGATCGCGCGGGGTTACTGAACCGTGATGTGAAAAACGTACTTGGCCTGACGTTGCCGCAAACGCTGGAACAATACGACGTTATGCTGACCCAGGATGACGCGGTAAAAAATATGTTCCGCGCAGGTCCTGCAGGCATTCGTACCACACAGGCATTCTCGCAAGATTGCCGTTGGGATACGCTGGACGACGATCGCGCCAATGGCTGTATCCGCTCGCTGGAACACGCCTACAGCAAAGACGGCGGCCTGGCGGTGCTCTACGGTAACTTTGCGGAAAACGGCTGCATCGTGAAAACGGCAGGCGTCGATGACAGCATCCTCAAATTCACCGGCCCGGCGAAAGTGTACGAAAGCCAGGACGATGCGGTAGAAGCGATTCTCGGCGGTAAAGTTGTCGCCGGAGATGTGGTAGTAATTCGCTATGAAGGCCCGAAAGGCGGTCCGGGGATGCAGGAAATGCTCTACCCAACCAGCTTCCTGAAATCAATGGGTCTCGGCAAAGCCTGTGCGCTGATCACCGACGGTCGTTTCTCTGGTGGCACCTCTGGTCTTTCCATCGGCCACGTCTCACCGGAAGCGGCAAGCGGCGGCAGCATTGGCCTGATTGAAGATGGTGACCTGATCGCTATCGACATCCCGAACCGTGGCATTCAGTTACAGGTAAGCGATGCCGAACTGGCGGCGCGTCGTGAAGCGCAGGACGCTCGAGGTGACAAAGCCTGGACGCCGAAAAATCGTGAACGTCAGGTCTCCTTTGCCCTGCGTGCTTATGCCAGCCTGGCAACCAGCGCCGACAAAGGCGCGGTGCGCGATAAATCGAAACTGGGGGGTTAA

SEQ ID NO: 17 - protein, 585 aa, Saccharomyces cerevisiae
MGLLTKVATSRQFSTTRCVAKKLNKYSYIITEPKGQGASQAMLYATGFKKEDFKKPQVGVGSCWWSGNPCNMHLLDLNNRCSQSIEKAGLKAMQFNTIGVSDGISMGTKGMRYSLQSREIIADSFETIMMAQHYDANIAIPSCDKNMPGVMMAMGRHNRPSIMVYGGTILPGHPTCGSSKISKNIDIVSAFQSYGEYISKQFTEEEREDVVEHACPGPGSCGGMYTANTMASAAEVLGLTIPNSSSFPAVSKEKLAECDNIGEYIKKTMELGILPRDILTKEAFENAITYVVATGGSTNAVLHLVAVAHSAGVKLSPDDFQRISDTTPLIGDFKPSGKYVMADLINVGGTQSVIKYLYENNMLHGNTMTVTGDTLAERAKKAPSLPEGQEIIKPLSHPIKANGHLQILYGSLAPGGAVGKITGKEGTYFKGRARVFEEEGAFIEALERGEIKKGEKTVVVIRYEGPRGAPGMPEMLKPSSALMGYGLGKDVALLTDGRFSGGSHGFLIGHIVPEAAEGGPIGLVRDGDEIIIDADNNKIDLLVSDKEMAQRKQSWVAPPPRYTRGTLSKYAKLVSNASNGCVLDA

SEQ ID NO: 18 - protein, 1131 aa, Saccharomyces cerevisiae
ATGACCTTGGCACCCCTAGACGCCTCCAAAGTTAAGATAACTACCACACAACATGCATCTAAGCCAAAACCGAACAGTGAGTTAGTGTTTGGCAAGAGCTTCACGGACCACATGTTAACTGCGGAATGGACAGCTGAAAAAGGGTGGGGTACCCCAGAGATTAAACCTTATCAAAATCTGTCTTTAGACCCTTCCGCGGTGGTTTTCCATTATGCTTTTGAGCTATTCGAAGGGATGAAGGCTTACAGAACGGTGGACAACAAAATTACAATGTTTCGTCCAGATATGAATATGAAGCGCATGAATAAGTCTGCTCAGAGAATCTGTTTGCCAACGTTCGACCCAGAAGAGTTGATTACCCTAATTGGGAAACTGATCCAGCAAGATAAGTGCTTAGTTCCTGAAGGAAAAGGTTACTCTTTATATATCAGGCCTACATTAATCGGCACTACGGCCGGTTTAGGGGTTTCCACGCCTGATAGAGCCTTGCTATATGTCATTTGCTGCCCTGTGGGTCCTTATTACAAAACTGGATTTAAGGCGGTCAGACTGGAAGCCACTGATTATGCCACAAGAGCTTGGCCAGGAGGCTGTGGTGACAAGAAACTAGGTGCAAACTACGCCCCCTGCGTCCTGCCACAATTGCAAGCTGCTTCAAGGGGTTACCAACAAAATTTATGGCTATTTGGTCCAAATAACAACATTACTGAAGTCGGCACCATGAATGCTTTTTTCGTGTTTAAAGATAGTAAAACGGGCAAGAAGGAACTAGTTACTGCTCCACTAGACGGTACCATTTTGGAAGGTGTTACTAGGGATTCCATTTTAAATCTTGCTAAAGAAAGACTCGAACCAAGTGAATGGACCATTAGTGAACGCTACTTCACTATAGGCGAAGTTACTGAGAGATCCAAGAACGGTGAACTACTTGAAGCCTTTGGTTCTGGTACTGCTGCGATTGTTTCTCCCATTAAGGAAATCGGCTGGAAAGGCGAACAAATTAATATTCCGTTGTTGCCCGGCGAACAAACCGGTCCATTGGCCAAAGAAGTTGCACAATGGATTAATGGAATCCAATATGGCGAGACTGAGCATGGCAATTGGTCAAGGGTTGTTACTGATTTGAACTGA

SEQ ID NO: 19 - protein, 550 aa, Methanococcus maripaludis
MISDNVKKGVIRTPNRALLKACGYTDEDMEKPFIGIVNSFTEVVPGHIHLRTLSEAAKHGVYANGGTPFEFNTIGICDGIAMGHEGMKYSLPSREIIADAVESMARAHGFDGLVLIPTCDKIVPGMIMGALRLNIPFIVVTGGPMLPGEFQGKKYELISLFEGVGEYQVGKITEEELKCIEDCACSGAGSCAGLYTANSMACLTEALGLSLPMCATTHAVDAQKVRLAKKSGSKIVDMVKEDLKPTDILTKEAFENAILVDLALGGSTNTTLHIPAIANEIENKFITLDDFDRLSDEVPHIASIKPGGEHYMIDLHNAGGIPAVLNVLKEKIRDTKTVDGRSILEIAESVKYINYDVIRKVEAPVHETAGLRVLKGNLAPNGCVVKIGAVHPKMYKHDGPAKVYNSEDEAISAILGGKIVEGDVIVIRYEGPSGGPGMREMLSPTSAICGMGLDDSVALITDGRFSGGSRGPCIGHVSPEAAAGGVIAAIENGDIIKIDMIEKEINVDLDESVIKERLSKLGEFEPKIKKGYLSRYSKLVSSADEGAVLK

SEQ ID NO: 20 - protein, 1653 aa, Methanococcus maripaludis
ATGATAAGTGATAACGTCAAAAAGGGAGTTATAAGAACTCCAAACCGAGCTCTTTTAAAGGCTTGCGGATATACAGACGAAGACATGGAAAAACCATTTATTGGAATTGTAAACAGCTTTACAGAAGTTGTTCCCGGCCACATTCACTTAAGAACATTATCAGAAGCGGCTAAACATGGTGTTTATGCAAACGGTGGAACACCATTTGAATTTAATACCATTGGAATTTGCGACGGTATTGCAATGGGCCACGAAGGTATGAAATACTCTTTACCTTCAAGAGAAATTATTGCAGACGCTGTTGAATCAATGGCAAGAGCACATGGATTTGATGGTCTTGTTTTAATTCCTACGTGTGATAAAATCGTTCCTGGAATGATAATGGGTGCTTTAAGACTAAACATTCCATTTATTGTAGTTACTGGAGGACCAATGCTTCCCGGAGAATTCCAAGGTAAAAAATACGAACTTATCAGCCTTTTTGAAGGTGTCGGAGAATACCAAGTTGGAAAAATTACTGAAGAAGAGTTAAAGTGCATTGAAGACTGTGCATGTTCAGGTGCTGGAAGTTGTGCAGGGCTTTACACTGCAAACAGTATGGCCTGCCTTACAGAAGCTTTGGGACTCTCTCTTCCAATGTGTGCAACAACGCATGCAGTTGATGCCCAAAAAGTTAGGCTTGCTAAAAAAAGTGGCTCAAAAATTGTTGATATGGTAAAAGAAGACCTAAAACCAACAGACATATTAACAAAAGAAGCTTTTGAAAATGCTATTTTAGTTGACCTTGCACTTGGTGGATCAACAAACACAACATTACACATTCCTGCAATTGCAAATGAAATTGAAAATAAATTCATAACTCTCGATGACTTTGACAGGTTAAGCGATGAAGTTCCACACATTGCATCAATCAAACCAGGTGGAGAACACTACATGATTGATTTACACAATGCTGGAGGTATTCCTGCGGTATTGAACGTTTTAAAAGAAAAAATTAGAGATACAAAAACAGTTGATGGAAGAAGCATTTTGGAAATCGCAGAATCTGTTAAATACATAAATTACGACGTTATAAGAAAAGTGGAAGCTCCGGTTCACGAAACTGCTGGTTTAAGGGTTTTAAAGGGAAATCTTGCTCCAAACGGTTGCGTTGTAAAAATCGGTGCAGTACATCCGAAAATGTACAAACACGATGGACCTGCAAAAGTTTACAATTCCGAAGATGAAGCAATTTCTGCGATACTTGGCGGAAAAATTGTAGAAGGGGACGTTATAGTAATCAGATACGAAGGACCATCAGGAGGCCCTGGAATGAGAGAAATGCTCTCCCCAACTTCAGCAATCTGTGGAATGGGTCTTGATGACAGCGTTGCATTGATTACTGATGGAAGATTCAGTGGTGGAAGTAGGGGCCCATGTATCGGACACGTTTCTCCAGAAGCTGCAGCTGGCGGAGTAATTGCTGCAATTGAAAACGGGGATATCATCAAAATCGACATGATTGAAAAAGAAATAAATGTTGATTTAGATGAATCAGTCATTAAAGAAAGACTCTCAAAACTGGGAGAATTTGAGCCTAAAATCAAAAAAGGCTATTTATCAAGATACTCAAAACTTGTCTCATCTGCTGACGAAGGGGCAGTTTTAAAATAA

SEQ ID NO: 21 - protein, 558 aa, Bacillus subtilis
MAELRSNMITQGIDRAPHRSLLRAAGVKEEDFGKPFIAVCNSYIDIVPGHVHLQEFGKIVKEAIREAGGVPFEFNTIGVDDGIAMGHIGMRYSLPSREIIADSVETVVSAHWFDGMVCIPNCDKITPGMLMAAMRINIPTIFVSGGPMAAGRTSDGRKISLSSVFEGVGAYQAGKINENELQELEQFGCPTCGSCSGMFTANSMNCLSEALGLALPGNGTILATSPERKEFVRKSAAQLMETIRKDIKPRDIVTVKAIDNAFALDMALGGSTNTVLHTLALANEAGVEYSLERINEVAERVPHLAKLAPASDVFIEDLHEAGGVSAALNELSKKEGALHLDALTVTGKTLGETIAGHEVKDYDVIHPLDQPFTEKGGLAVLFGNLAPDGAIIKTGGVQNGITRHEGPAVVFDSQDEALDGIINRKVKEGDVVIIRYEGPKGGPGMPEMLAPTSQIVGMGLGPKVALITDGRFSGASRGLSIGHVSPEAAEGGPLAFVENGDHIIVDIEKRILDVQVPEEEWEKRKANWKGFEPKVKTGYLARYSKLVTSANTGGIMKI

SEQ ID NO: 22 - protein, 1677 aa, Bacillus subtilis
ATGGCAGAATTACGCAGTAATATGATCACACAAGGAATCGATAGAGCTCCGCACCGCAGTTTGCTTCGTGCAGCAGGGGTAAAAGAAGAGGATTTCGGCAAGCCGTTTATTGCGGTGTGTAATTCATACATTGATATCGTTCCCGGTCATGTTCACTTGCAGGAGTTTGGGAAAATCGTAAAAGAAGCAATCAGAGAAGCAGGGGGCGTTCCGTTTGAATTTAATACCATTGGGGTAGATGATGGCATCGCAATGGGGCATATCGGTATGAGATATTCGCTGCCAAGCCGTGAAATTATCGCAGACTCTGTGGAAACGGTTGTATCCGCACACTGGTTTGACGGAATGGTCTGTATTCCGAACTGCGACAAAATCACACCGGGAATGCTTATGGCGGCAATGCGCATCAACATTCCGACGATTTTTGTCAGCGGCGGACCGATGGCGGCAGGAAGAACAAGTTACGGGCGAAAAATCTCCCTTTCCTCAGTATTCGAAGGGGTAGGCGCCTACCAAGCAGGGAAAATCAACGAAAACGAGCTTCAAGAACTAGAGCAGTTCGGATGCCCAACGTGCGGGTCTTGCTCAGGCATGTTTACGGCGAACTCAATGAACTGTCTGTCAGAAGCACTTGGTCTTGCTTTGCCGGGTAATGGAACCATTCTGGCAACATCTCCGGAACGCAAAGAGTTTGTGAGAAAATCGGCTGCGCAATTAATGGAAACGATTCGCAAAGATATCAAACCGCGTGATATTGTTACAGTAAAAGCGATTGATAACGCGTTTGCACTCGATATGGCGCTCGGAGGTTCTACAAATACCGTTCTTCATACCCTTGCCCTTGCAAACGAAGCCGGCGTTGAATACTCTTTAGAACGCATTAACGAAGTCGCTGAGCGCGTGCCGCACTTGGCTAAGCTGGCGCCTGCATCGGATGTGTTTATTGAAGATCTTCACGAAGCGGGCGGCGTTTCAGCGGCTCTGAATGAGCTTTCGAAGAAAGAAGGAGCGCTTCATTTAGATGCGCTGACTGTTACAGGAAAAACTCTTGGAGAAACCATTGCCGGACATGAAGTAAAGGATTATGACGTCATTCACCCGCTGGATCAACCATTCACTGAAAAGGGAGGCCTTGCTGTTTTATTCGGTAATCTAGCTCCGGACGGCGCTATCATTAAAACAGGCGGCGTACAGAATGGGATTACAAGACACGAAGGGCCGGCTGTCGTATTCGATTCTCAGGACGAGGCGCTTGACGGCATTATCAACCGAAAAGTAAAAGAAGGCGACGTTGTCATCATCAGATACGAAGGGCCAAAAGGCGGACCTGGCATGCCGGAAATGCTGGCGCCAACATCCCAAATCGTTGGAATGGGACTCGGGCCAAAAGTGGCATTGATTACGGACGGACGTTTTTCCGGAGCCTCCCGTGGCCTCTCAATCGGCCACGTATCACCTGAGGCCGCTGAGGGCGGGCCGCTTGCCTTTGTTGAAAACGGAGACCATATTATCGTTGATATTGAAAAACGCATCTTGGATGTACAAGTGCCAGAAGAAGAGTGGGAAAAACGAAAAGCGAACTGGAAAGGTTTTGAACCGAAAGTGAAAACCGGCTACCTGGCACGTTATTCTAAACTTGTGACAAGTGCCAACACCGGCGGTATTATGAAAATCTAG

SEQ ID NO: 23 - protein, 547 aa, Lactococcus lactis
MYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 24 - DNA, 1828 bp, Lactococcus lactis
tttaaataagtcaatatcgttgacttatttagaagaaagagttattctttaaatgtcaagttagttgactaaattaaatataaaatatggaggaatgtgatgtatacagtaggagattacctgttagaccgattacacgagttgggaattgaagaaatttttggagttcctggtgactataacttacaatttttagatcaaattatttcacgcgaagatatgaaatggattggaaatgctaatgaattaaatgcttcttatatggctgatggttatgctcgtactaaaaaagctgccgcatttctcaccacatttggagtcggcgaattgagtgcgatcaatggactggcaggaagttatgccgaaaatttaccagtagtagaaattgttggttcaccaacttcaaaagtacaaaatgacggaaaatttgtccatcatacactagcagatggtgattttaaacactttatgaagatgcatgaacctgttacagcagcgcggactttactgacagcagaaaatgccacatatgaaattgaccgagtactttctcaattactaaaagaaagaaaaccagtctatattaacttaccagtcgatgttgctgcagcaaaagcagagaagcctgcattatctttagaaaaagaaagctctacaacaaatacaactgaacaagtgattttgagtaagattgaagaaagtttgaaaaatgcccaaaaaccagtagtgattgcaggacacgaagtaattagttttggtttagaaaaaacggtaactcagtttgtttcagaaacaaaactaccgattacgacactaaattttggtaaaagtgctgttgatgaatctttgccctcatttttaggaatatataacgggaaactttcagaaatcagtcttaaaaattttgtggagtccgcagactttatcctaatgcttggagtgaagcttacggactcctcaacaggtgcattcacacatcatttagatgaaaataaaatgatttcactaaacatagatgaaggaataattttcaataaagtggtagaagattttgattttagagcagtggtttcttctttatcagaattaaaaggaatagaatatgaaggacaatatattgataagcaatatgaagaatttattccatcaagtgctcccttatcacaagaccgtctatggcaggcagttgaaagtttgactcaaagcaatgaaacaatcgttgctgaacaaggaacctcattttttggagcttcaacaattttcttaaaatcaaatagtcgttttattggacaacctttatggggttctattggatatacttttccagcggctttaggaagccaaattgcggataaagagagcagacaccttttatttattggtgatggttcacttcaacttaccgtacaagaattaggactatcaatcagagaaaaactcaatccaatttgttttatcataaataatgatggttatacagttgaaagagaaatccacggacctactcaaagttataacgacattccaatgtggaattactcgaaattaccagaaacatttggagcaacagaagatcgtgtagtatcaaaaattgttagaacagagaatgaatttgtgtctgtcatgaaagaagcccaagcagatgtcaatagaatgtattggatagaactagttttggaaaaagaagatgcgccaaaattactgaaaaaaatgggtaaattatttgctgagcaaaataaatagatatcaacggatgatgaaaagtaaaatagacaaagtccaataattttataaaaagtaaaaacattaggattttcctaatgttttt

SEQ ID NO: 25 - protein, 548 aa, Lactococcus lactis
MYTVGDYLLDRLHELGIEEIFGVPGDYNLQFLDQIISHKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENSTSNTSDQEILNKIQESLKNAKKPIVITGHEIISFGLEKTVTQFISKTKLPITTLNFGKSSVDEALPSFLGIYNGTLSEPNLKEFVESADFILMLGVKLTDSSTGAFTHHLNENKMISLNIDEGKIFNERIQNFDFESLISSLLDLSEIEYKGKYIDKKQEDFVPSNALLSQDRLWQAVENLTQSNETIVAEQGTSFFGASSIFLKSKSHFIGQPLWGSIGYTFPAALGSQIADKESRHLLFIGDGSLQLTVQELGLAIREKINPICFIINNDGYTVEREIHGPNQSYNDIPMWNYSKLPESFGATEDRVVSKIVRTENEFVSVMKEAQADPNRMYWIELILAKEGAPKVLKKMGKLFAEQNKS

SEQ ID NO: 26 - DNA, 1954 bp, Lactococcus lactis
ctagagttttctttagtcataattcactccttttattagtctattatacttgataattcaaataagtcaatatcgttgacttatttaaagaaaagcgttattctataaatgtcaagttgattgaccaatatataataaaatatggaggaatgcgatgtatacagtaggagattacctattagaccgattacacgagttaggaattgaagaaatttttggagtccctggagactataacttacaatttttagatcaaattatttcccacaaggatatgaaatgggtcggaaatgctaatgaattaaatgcttcatatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagttcaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactattaaaagaaagaaaacctgtctatatcaacttaccagttgatgttgctgctgcaaaagcagagaaaccctcactccctttgaaaaaggaaaactcaacttcaaatacaagtgaccaagaaattttgaacaaaattcaagaaagcttgaaaaatgccaaaaaaccaatcgtgattacaggacatgaaataattagttttggcttagaaaaaacagtcactcaatttatttcaaagacaaaactacctattacgacattaaactttggtaaaagttcagttgatgaagccctcccttcatttttaggaatctataatggtacactctcagagcctaatcttaaagaattcgtggaatcagccgacttcatcttgatgcttggagttaaactcacagactcttcaacaggagccttcactcatcatttaaatgaaaataaaatgatttcactgaatatagatgaaggaaaaatatttaacgaaagaatccaaaattttgattttgaatccctcatctcctctctcttagacctaagcgaaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaatcaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcgtttggagcaacagaagatcgagtagtctcaaaaatcgttagaactgaaaatgaatttgtgtctgtcatgaaagaagctcaagcagatccaaatagaatgtactggattgagttaattttggcaaaagaaggtgcaccaaaagtactgaaaaaaatgggcaaactatttgctgaacaaaataaatcataatttataaatagtaaaaaacattaggaaatacctaatgtttttttgttgactaaatcaatccctctttatatagaaaaccttagtttctcaaagacaacttaattaagcctgccaaattggaactcgcaaaatgtaatctatcctctgctccta

SEQ ID NO: 27 - protein, 550 aa, Salmonella typhimurium
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVLQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 28 - protein, 1653 aa, Salmonella typhimurium
TTATCCCCCGTTGCGGGCTTCCAGCGCCCGGGTCACGGTACGCAGTAATTCCGGCAGATCGGCTTTTGGCAACATCACTTCAATAAATGACAGACGTTGTGGGCGCGCCAACCGTTCGAGGACCTCTGCCAGTTGGATAGCCTGCGTCACCCGCCAGCACTCCGCCTGTTGCGCCGCGTTTAGCGCCGGTGGTATCTGCGTCCAGTTCCAGCTCGCGATGTCGTTATACCGCTGGGCCGCGCCGTGAATGGCGCGCTCTACGGTATAGCCGTCATTGTTGAGCAGCAGGATGACCGGCGCCTGCCCGTCGCGTAACATCGAGCCCATCTCCTGAATCGTGAGCTGCGCCGCGCCATCGCCGATAATCAGAATCACCCGCCGATCGGGACAGGCGGTTTGCGCGCCAAACGCGGCGGGCAAGGAATAGCCGATAGACCCCCACAGCGGCTGTAACACAACTTCCGCGCCGTCAGGAAGCGACAGCGCGGCAGCGCCAAAAGCTGCTGTCCCCTGGTCGACAAGGATAATATCTCCGGGTTTGAGATACTGCTGTAAGGTTTGCCAGAAGCTTTCCTGGGTCAGTTCTCCTTTATCAATCCGCACTGGCTGTCCGGCGGAACGCGTCGGCGGCGGCGCAAAAGCGCATTCCAGGCACAGTTCGCGCAGCGTAGACACCGCCTGCGCCATCGGGAGGTTGAACCAGGTTTCGCCGATGCGCGACGCGTAAGGCTGAATCTCCAGCGTGCGTTCCGCCGGTAATTGTTGGGTAAATCCGGCCGTAAGGGTATCGACAAAACGGGTGCCGACGCAGATAACCCTATCGGCGTCCTCTATGGCCTGACGCACTTCTTTGCTGCTGGCGCCAGCGCTATAGGTGCCAACGAAGTTCGGGTGCTGTTCATCAAAAAGCCCCTTCCCCATCAGTAGTGTCGCATGAGCGATGGGCGTTTCCGCCATCCAGCGCTGCAACAGTGGTCGTAAACCAAAACGCCCGGCAAGAAAGTCGGCCAATAGCGCAATGCGCCGACTGTTCATCAGGCACTGACGGGCGTGATAACGAAAGGCCGTCTCCACGCCGCTTTGCGCTTCATGCACGGGCAACGCCAGCGCCTGCGTAGGTGGGATGGCCGTTTTTTTCGCCACATCGGCGGGCAACATGATGTATCCTGGCCTGCGTGCGGCAAGCATTTCACCCAACACGCGGTCAATCTCGAAACAGGCGTTCTGTTCATCTAATATTGCGCTGGCAGCGGATATCGCCTGACTCATGCGATAAAAATGACGAAAATCGCCGTCACCGAGGGTATGGTGCATCAATTCGCCACGCTGCTGCGCAGCGCTACAGGGCGCGCCGACGATATGCAAGACCGGGACATATTCCGCGTAACTGCCCGCGATACCGTTAATAGCGCTAAGTTCTCCCACGCCAAAGGTGGTGAGTAGCGCTCCAGCGCCCGACATGCGCGCATAGCCGTCCGCGGCATAAGCGGCGTTCAGCTCATTGGCGCATCCCACCCAACGCAGGGTCGGGTGGTCAATCACATGGTCAAGAAACTGCAAGTTATAATCGCCCGGTACGCCAAAAAGATGGCCAATGCCGCATCCTGCCAGTCTGTCCAGCAAATAGTCGGCCACGGTATAGGGGTTTTGCAT

SEQ ID NO: 29 - protein, 554 aa, Clostridium acetobutylicum
MKSEYTIGRYLLDRLSELGIRHIFGVPGDYNLSFLDYIMEYKGIDWVGNCNELNAGYAADGYARINGIGAILTTFGVGELSAINAIAGAYAEQVPVVKITGIPTAKVRDNGLYVHHTLGDGRFDHFFEMFREVTVAEALLSEENAAQEIDRVLISCWRQKRPVLINLPIDVYDKPINKPLKPLLDYTISSNKEAACEFVTEIVPIINRAKKPVILADYGVYRYQVQHVLKNLAEKTGFPVATLSMGKGVFNEAHPQFIGVYNGDVSSPYLRQRVDEADCIISVGVKLTDSTTGGFSHGFSKRNVIHIDPFSIKAKGKKYAPITMKDALTELTSKIEHRNFEDLDIKPYKSDNQKYFAKEKPITQKRFFERIAHFIKEKDVLLAEQGTCFFGASTIQLPKDATFIGQPLWGSIGYTLPALLGSQLADQKRRNILLIGDGAFQMTAQEISTMLRLQIKPIIFLINNDGYTIERAIHGREQVYNNIQMWRYHNVPKVLGPKECSLTFKVQSETELEKALLVADKDCEHLIFIEVVMDRYDKPEPLERLSKRFANQNN

SEQ ID NO: 30 - DNA, 1665 bp, Clostridium acetobutylicum
ttgaagagtgaatacacaattggaagatatttgttagaccgtttatcagagttgggtattcggcatatctttggtgtacctggagattacaatctatcctttttagactatataatggagtacaaagggatagattgggttggaaattgcaatgaattgaatgctgggtatgctgctgatggatatgcaagaataaatggaattggagccatacttacaacatttggtgttggagaattaagtgccattaacgcaattgctggggcatacgctgagcaagttccagttgttaaaattacaggtatccccacagcaaaagttagggacaatggattatatgtacaccacacattaggtgacggaaggtttgatcacttttttgaaatgtttagagaagtaacagttgctgaggcattactaagcgaagaaaatgcagcacaagaaattgatcgtgttcttatttcatgctggagacaaaaacgtcctgttcttataaatttaccgattgatgtatatgataaaccaattaacaaaccattaaagccattactcgattatactatttcaagtaacaaagaggctgcatgtgaatttgttacagaaatagtacctataataaatagggcaaaaaagcctgttattcttgcagattatggagtatatcgttaccaagttcaacatgtgcttaaaaacttggccgaaaaaaccggatttcctgtggctacactaagtatgggaaaaggtgttttcaatgaagcacaccctcaatttattggtgtttataatggtgatgtaagttctccttatttaaggcagcgagttgatgaagcagactgcattattagcgttggtgtaaaattgacggattcaaccacagggggattttctcatggattttctaaaaggaatgtaattcacattgatcctttttcaataaaggcaaaaggtaaaaaatatgcacctattacgatgaaagatgctttaacagaattaacaagtaaaattgagcatagaaactttgaggatttagatataaagccttacaaatcagataatcaaaagtattttgcaaaagagaagccaattacacaaaaacgtttttttgagcgtattgctcactttataaaagaaaaagatgtattattagcagaacagggtacatgcttttttggtgcgtcaaccatacaactacccaaagatgcaacttttattggtcaacctttatggggatctattggatacacacttcctgctttattaggttcacaattagctgatcaaaaaaggcgtaatattcttttaattggggatggtgcatttcaaatgacagcacaagaaatttcaacaatgcttcgtttacaaatcaaacctattatttttttaattaataacgatggttatacaattgaacgtgctattcatggtagagaacaagtatataacaatattcaaatgtggcgatatcataatgttccaaaggttttaggtcctaaagaatgcagcttaacctttaaagtacaaagtgaaactgaacttgaaaaggctcttttagtggcagataaggattgtgaacatttgatttttatagaagttgttatggatcgttatgataaacccgagcctttagaacgtctttcgaaacgttttgcaaatcaaaataattag

SEQ ID NO: 31 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 32 - protein, 939 aa, Saccharomyces cerevisiae
ATGCCTGCTACGTTAAAGAATTCTTCTGCTACATTAAAACTAAATACTGGTGCCTCCATTCCAGTGTTGGGTTTCGGCACTTGGCGTTCCGTTGACAATAACGGTTACCATTCTGTAATTGCAGCTTTGAAAGCTGGATACAGACACATTGATGCTGCGGCTATCTATTTGAATGAAGAAGAAGTTGGCAGGGCTATTAAAGATTCCGGAGTCCCTCGTGAGGAAATTTTTATTACTACTAAGCTTTGGGGTACGGAACAACGTGATCCGGAAGCTGCTCTAAACAAGTCTTTGAAAAGACTAGGCTTGGATTATGTTGACCTATATCTGATGCATTGGCCAGTGCCTTTGAAAACCGACAGAGTTACTGATGGTAACGTTCTGTGCATTCCAACATTAGAAGATGGCACTGTTGACATCGATACTAAGGAATGGAATTTTATCAAGACGTGGGAGTTGATGCAAGAGTTGCCAAAGACGGGCAAAACTAAAGCCGTTGGTGTCTCTAATTTTTCTATTAACAACATTAAAGAATTATTAGAATCTCCAAATAACAAGGTGGTACCAGCTACTAATCAAATTGAAATTCATCCATTGCTACCACAAGACGAATTGATTGCCTTTTGTAAGGAAAAGGGTATTGTTGTTGAAGCCTACTCACCATTTGGGAGTGCTAATGCTCCTTTACTAAAAGAGCAAGCAATTATTGATATGGCTAAAAAGCACGGCGTTGAGCCAGCACAGCTTATTATCAGTTGGAGTATTCAAAGAGGCTACGTTGTTCTGGCCAAATCGGTTAATCCTGAAAGAATTGTATCCAATTTTAAGATTTTCACTCTGCCTGAGGATGATTTCAAGACTATTAGTAACCTATCCAAAGTGCATGGTACAAAGAGAGTCGTTGATATGAAGTGGGGATCCTTCCCAATTTTCCAATGA

SEQ ID NO: 33 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 34 - DNA, 1083 bp, Saccharomyces cerevisiae
ctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagccatatggctttagcgataacatttcgtgttgttctggtatagagattgagacaattctaccaccaaccttcatagcctttggcataatgttgaagtcaatgtcggtaagggaggaagcacagactacaatcaggtcgaaggtgtcaaagtacttttcaccccaatcaccttcttctaatgtagcaatgtagtgatcggcgcccatcttcattgcatcttctctttttctcgaagaacgagaaataacatacgtctctgcccccatggctttggaaatcaatgtacccatactgccgataccaccaagaccaactataccaacttttttacctggaccgcaaccgttacgaaccaatggagagtacacagtcaaaccaccacataatagtggagcagccaaatgtgatggaatattctctgggataggcaccacaaaatgttcatgaactctgacgtagtttgcatagccaccctgcgacacatagccgtcttcataaggctgactgtatgtggtaacaaacttggtgcagtatggttcattatcattcttacaacggtcacattccaagcatgaaaagacttgagcacctacaccaacacgttgaccgactttcaacccactgtttgacttgggccctagcttgacaactttaccaacgatttcatgaccaacgactagcggcatcttcatattgccccaatgaccagctgcacaatgaatatcactaccgcagacaccacatgcttcgatcttaatgtcaatgtcatgatcgtaaaatggttttgggtcatactttgtcttctttgggtttttccaatcttcgtgtgattgaatagcgataccttcaaatttctcaggataagacat

SEQ ID NO: 35 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 36 - protein, 387 aa, Escherichia coli; identical to SEQ ID NO: 35

SEQ ID NO: 37 - protein, 389 aa, Clostridium acetobutylicum
MLSFDYSIPTKVFFGKGKIDVIGEEIKKYGSRVLIVYGGGSIKRNGIYDRATAILKENNIAFYELSGVEPNPRITTVKKGIEICRENNVDLVLAIGGGSAIDCSKVIAAGVYYDGDTWDMVKDPSKITKVLPIASILTLSATGSEMDQIAVISNMETNEKLGVGHDDMRPKFSVLDPTYTFTVPKNQTAAGTADIMSHTFESYFSGVEGAYVQDGIAEAILRTCIKYGKIAMEKTDDYEARANLMWASSLAINGLLSLGKDRKWSCHPMEHELSAYYDITHGVGLAILTPNWMEYILNDDTLHKFVSYGINVWGIDKNKDNYEIAREAIKNTREYFNSLGIPSKLREVGIGKDKLELMAKQAVRNSGGTIGSLRPINAEDVLEIFKKSY

SEQ ID NO: 38 - protein, 1170 aa, Clostridium acetobutylicum
TTAATAAGATTTTTTAAATATCTCAAGAACATCCTCTGCATTTATTGGTCTTAAACTTCCTATTGTTCCTCCAGAATTTCTAACAGCTTGCTTTGCCATTAGTTCTAGTTTATCTTTTCCTATTCCAACTTCTCTAAGCTTTGAAGGAATACCCAATGAATTAAAGTATTCTCTCGTATTTTTAATAGCCTCTCGTGCTATTTCATAGTTATCTTTGTTCTTGTCTATTCCCCAAACATTTATTCCATAAGAAACAAATTTATGAAGTGTATCGTCATTTAGAATATATTCCATCCAATTAGGTGTTAAAATTGCAAGTCCTACACCATGTGTTATATCATAATATGCACTTAACTCGTGTTCCATAGGATGACAACTCCATTTTCTATCCTTACCAAGTGATAATAGACCATTTATAGCTAAACTTGAAGCCCACATCAAATTAGCTCTAGCCTCGTAATCATCAGTCTTCTCCATTGCTATTTTTCCATACTTTATACATGTTCTTAAGATTGCTTCTGCTATACCGTCCTGCACATAAGCACCTTCAACACCACTAAAGTAAGATTCAAAGGTGTGACTCATAATGTCAGCTGTTCCCGCTGCTGTTTGATTTTTAGGTACTGTAAAAGTATATGTAGGATCTAACACTGAAAATTTAGGTCTCATATCATCATGTCCTACTCCAAGCTTTTCATTAGTCTCCATATTTGAAATTACTGCAATTTGATCCATTTCAGACCCTGTTGCTGAAAGAGTAAGTATACTTGCAATTGGAAGAACTTTAGTTATTTTAGATGGATCTTTAACCATGTCCCATGTATCGCCATCATAATAAACTCCAGCTGCAATTACCTTAGAACAGTCTATTGCACTTCCTCCCCCTATTGCTAATACTAAATCCACATTATTTTCTCTACATATTTCTATGCCTTTTTTTACTGTTGTTATCCTAGGATTTGGCTCTACTCCTGAAAGTTCATAGAAAGCTATATTGTTTTCTTTTAATATAGCTGTTGCTCTATCATATATACCGTTCCTTTTTATACTTCCTCCGCCATAAACTATAAGCACTCTTGAGCCATATTTCTTAATTTCTTCTCCAATTACGTCTATTTTTCCTTTTCCAAAAAAAACTTTAGTTGGTATTGAATAATCAAAACTTAGCAT

SEQ ID NO: 39 - protein, 390 aa, Clostridium acetobutylicum
MVDFEYSIPTRIFFGKDKINVLGRELKKYGSKVLIVYGGGSIKRNGIYDKAVSILEKNSIKFYELAGVEPNPRVTTVEKGVKICRENGVEVVLAIGGGSAIDCAKVIAAACEYDGNPWDIVLDGSKIKRVLPIASILTIAATGSEMDTWAVINNMDTNEKLIAAHPDMAPKFSILDPTYTYTVPTNQTAAGTADIMSHIFEVYFSNTKTAYLQDRMAEALLRTCIKYGGIALEKPDDYEARANLMWASSLAINGLLTYGKDTNWSVHLMEHELSAYYDITHGVGLAILTPNWMEYILNNDTVYKFVEYGVNVWGIDKEKNHYDIAHQAIQKTRDYFVNVLGLPSRLRDVGIEEEKLDIMAKESVKLTGGTIGNLRPVNASEVLQIFKKSV

SEQ ID NO: 40 - protein, 1173 aa, Clostridium acetobutylicum
GTGGTTGATTTCGAATATTCAATACCAACTAGAATTTTTTTCGGTAAAGATAAGATAAATGTACTTGGAAGAGAGCTTAAAAAATATGGTTCTAAAGTGCTTATAGTTTATGGTGGAGGAAGTATAAAGAGAAATGGAATATATGATAAAGCTGTAAGTATACTTGAAAAAAACAGTATTAAATTTTATGAACTTGCAGGAGTAGAGCCAAATCCAAGAGTAACTACAGTTGAAAAAGGAGTTAAAATATGTAGAGAAAATGGAGTTGAAGTAGTACTAGCTATAGGTGGAGGAAGTGCAATAGATTGCGCAAAGGTTATAGCAGCAGCATGTGAATATGATGGAAATCCATGGGATATTGTGTTAGATGGCTCAAAAATAAAAAGGGTGCTTCCTATAGCTAGTATATTAACCATTGCTGCAACAGGATCAGAAATGGATACGTGGGCAGTAATAAATAATATGGATACAAACGAAAAACTAATTGCGGCACATCCAGATATGGCTCCTAAGTTTTCTATATTAGATCCAACGTATACGTATACCGTACCTACCAATCAAACAGCAGCAGGAACAGCTGATATTATGAGTCATATATTTGAGGTGTATTTTAGTAATACAAAAACAGCATATTTGCAGGATAGAATGGCAGAAGCGTTATTAAGAACTTGTATTAAATATGGAGGAATAGCTCTTGAGAAGCCGGATGATTATGAGGCAAGAGCCAATCTAATGTGGGCTTCAAGTCTTGCGATAAATGGACTTTTAACATATGGTAAAGACACTAATTGGAGTGTACACTTAATGGAACATGAATTAAGTGCTTATTACGACATAACACACGGCGTAGGGCTTGCAATTTTAACACCTAATTGGATGGAGTATATTTTAAATAATGATACAGTGTACAAGTTTGTTGAATATGGTGTAAATGTTTGGGGAATAGACAAAGAAAAAAATCACTATGACATAGCACATCAAGCAATACAAAAAACAAGAGATTACTTTGTAAATGTACTAGGTTTACCATCTAGACTGAGAGATGTTGGAATTGAAGAAGAAAAATTGGACATAATGGCAAAGGAATCAGTAAAGCTTACAGGAGGAACCATAGGAAACCTAAGACCAGTAAACGCCTCCGAAGTCCTACAAATATTCAAAAAATCTGTGTAA

SEQ ID NO: 41 - protein, 330 aa, Bacillus subtilis
MSTNRHQALGLTDQEAVDMYRTMLLARKIDERMWLLNRSGKIPFVISCQGQEAAQVGAAFALDREMDYVLPYYRDMGVVLAFGMTAKDLMMSGFAKAADPNSGGRQMPGHFGQKKNRIVTGSSPVTTQVPHAVGIALAGRMEKKDIAAFVTFGEGSSNQGDFHEGANFAAVHKLPVIFMCENNKYAISVPYDKQVACENISDRAIGYGMPGVTVNGNDPLEVYQAVKEARERARRGEGPTLIETISYRLTPHSSDDDDSSYRGREEVEEAKKSDPLLTYQAYLKETGLLSDEIEQTMLDEIMAIVNEATDEAENAPYAAPESALDYVYAK

SEQ ID NO: 42 - protein, 993 aa, Bacillus subtilis
ATGAGTACAAACCGACATCAAGCACTAGGGCTGACTGATCAGGAAGCCGTTGATATGTATAGAACCATGCTGTTAGCAAGAAAAATCGATGAAAGAATGTGGCTGTTAAACCGTTCTGGCAAAATTCCATTTGTAATCTCTTGTCAAGGACAGGAAGCAGCACAGGTAGGAGCGGCTTTCGCACTTGACCGTGAAATGGATTATGTATTGCCGTACTACAGAGACATGGGTGTCGTGCTCGCGTTTGGCATGACAGCAAAGGACTTAATGATGTCCGGGTTTGCAAAAGCAGCAGATCCGAACTCAGGAGGCCGCCAGATGCCGGGACATTTCGGACAAAAGAAAAACCGCATTGTGACGGGATCATCTCCGGTTACAACGCAAGTGCCGCACGCAGTCGGTATTGCGCTTGCGGGACGTATGGAGAAAAAGGATATCGCAGCCTTTGTTACATTCGGGGAAGGGTCTTCAAACCAAGGCGATTTCCATGAAGGGGCAAACTTTGCCGCTGTCCATAAGCTGCCGGTTATTTTCATGTGTGAAAACAACAAATACGCAATCTCAGTGCCTTACGATAAGCAAGTCGCATGTGAGAACATTTCCGACCGTGCCATAGGCTATGGGATGCCTGGCGTAACTGTGAATGGAAATGATCCGCTGGAAGTTTATCAAGCGGTTAAAGAAGCACGCGAAAGGGCACGCAGAGGAGAAGGCCCGACATTAATTGAAACGATTTCTTACCGCCTTACACCACATTCCAGTGATGACGATGACAGCAGCTACAGAGGCCGTGAAGAAGTAGAGGAAGCGAAAAAAAGTGATCCCCTGCTTACTTATCAAGCTTACTTAAAGGAAACAGGCCTGCTGTCCGATGAGATAGAACAAACCATGCTGGATGAAATTATGGCAATCGTAAATGAAGCGACGGATGAAGCGGAGAACGCCCCATATGCAGCTCCTGAGTCAGCGCTTGATTATGTTTATGCGAAGTAG

SEQ ID NO: 43 - protein, 327 aa, Bacillus subtilis
MSVMSYIDAINLAMKEEMERDSRVFVLGEDVGRKGGVFKATAGLYEQFGEERVMDTPLAESAIAGVGIGAAMYGMRPIAEMQFADFIMPAVNQIISEAAKIRYRSNNDWSCPIVVRAPYGGGVHGALYHSQSVEAIFANQPGLKIVMPSTPYDAKGLLKAAVRDEDPVLFFEHKRAYRLIKGEVPADDYVLPIGKADVKREGDDITVITYGLCVHFALQAAERLEKDGISAHVVDLRTVYPLDKEAIIEAASKTGKVLLVTEDTKEGSIMSEVAAIISEHCLFDLDAPIKRLAGPDIPAMPYAPTMEKYFMVNPDKVEAAMRELAEF

SEQ ID NO: 44 - protein, 984 aa, Bacillus subtilis
ATGTCAGTAATGTCATATATTGATGCAATCAATTTGGCGATGAAAGAAGAAATGGAACGAGATTCTCGCGTTTTCGTCCTTGGGGAAGATGTAGGAAGAAAAGGCGGTGTGTTTAAAGCGACAGCGGGACTCTATGAACAATTTGGGGAAGAGCGCGTTATGGATACGCCGCTTGCTGAATCTGCAATCGCAGGAGTCGGTATCGGAGCGGCAATGTACGGAATGAGACCGATTGCTGAAATGCAGTTTGCTGATTTCATTATGCCGGCAGTCAACCAAATTATTTCTGAAGCGGCTAAAATCCGCTACCGCAGCAACAATGACTGGAGCTGTCCGATTGTCGTCAGAGCGCCATACGGCGGAGGCGTGCACGGAGCCCTGTATCATTCTCAATCAGTCGAAGCAATTTTCGCCAACCAGCCCGGACTGAAAATTGTCATGCCATCAACACCATATGACGCGAAAGGGCTCTTAAAAGCCGCAGTTCGTGACGAAGACCCCGTGCTGTTTTTTGAGCACAAGCGGGCATACCGTCTGATAAAGGGCGAGGTTCCGGCTGATGATTATGTCCTGCCAATCGGCAAGGCGGACGTAAAAAGGGAAGGCGACGACATCACAGTGATCACATACGGCCTGTGTGTCCACTTCGCCTTACAAGCTGCAGAACGTCTCGAAAAAGATGGCATTTCAGCGCATGTGGTGGATTTAAGAACAGTTTACCCGCTTGATAAAGAAGCCATCATCGAAGCTGCGTCCAAAACTGGAAAGGTTCTTTTGGTCACAGAAGATACAAAAGAAGGCAGCATCATGAGCGAAGTAGCCGCAATTATATCCGAGCATTGTCTGTTCGACTTAGACGCGCCGATCAAACGGCTTGCAGGTCCTGATATTCCGGCTATGCCTTATGCGCCGACAATGGAAAAATACTTTATGGTCAACCCTGATAAAGTGGAAGCGGCGATGAGAGAATTAGCGGAGTTTTAA

SEQ ID NO: 45 - protein, 424 aa, Bacillus subtilis
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 46 - protein, 1275 aa, Bacillus subtilis
ATGGCAATTGAACAAATGACGATGCCGCAGCTTGGAGAAAGCGTAACAGAGGGGACGATCAGCAAATGGCTTGTCGCCCCCGGTGATAAAGTGAACAAATACGATCCGATCGCGGAAGTCATGACAGATAAGGTAAATGCAGAGGTTCCGTCTTCTTTTACTGGTACGATAACAGAGCTTGTGGGAGAAGAAGGCCAAACCCTGCAAGTCGGAGAAATGATTTGCAAAATTGAAACAGAAGGCGCGAATCCGGCTGAACAAAAACAAGAACAGCCAGCAGCATCAGAAGCCGCTGAGAACCCTGTTGCAAAAAGTGCTGGAGCAGCCGATCAGCCCAATAAAAAGCGCTACTCGCCAGCTGTTCTCCGTTTGGCCGGAGAGCACGGCATTGACCTCGATCAAGTGACAGGAACTGGTGCCGGCGGGCGCATCACACGAAAAGATATTCAGCGCTTAATTGAAACAGGCGGCGTGCAAGAACAGAATCCTGAGGAGCTGAAAACAGCAGCTCCTGCACCGAAGTCTGCATCAAAACCTGAGCCAAAAGAAGAGACGTCATATCCTGCGTCTGCAGCCGGTGATAAAGAAATCCCTGTCACAGGTGTAAGAAAAGCAATTGCTTCCAATATGAAGCGAAGCAAAACAGAAATTCCGCATGCTTGGACGATGATGGAAGTCGACGTCACAAATATGGTTGCATATCGCAACAGTATAAAAGATTCTTTTAAGAAGACAGAAGGCTTTAATTTAACGTTCTTCGCCTTTTTTGTAAAAGCGGTCGCTCAGGCGTTAAAAGAATTCCCGCAAATGAATAGCATGTGGGCGGGGGACAAAATTATTCAGAAAAAGGATATCAATATTTCAATTGCAGTTGCCACAGAGGATTCTTTATTTGTTCCGGTGATTAAAAACGCTGATGAAAAAACAATTAAAGGCATTGCGAAAGACATTACCGGCCTAGCTAAAAAAGTAAGAGACGGAAAACTCACTGCAGATGACATGCAGGGAGGCACGTTTACCGTCAACAACACAGGTTCGTTCGGGTCTGTTCAGTCGATGGGCATTATCAACTACCCTCAGGCTGCGATTCTTCAAGTAGAATCCATCGTCAAACGCCCGGTTGTCATGGACAATGGCATGATTGCTGTCAGAGACATGGTTAATCTGTGCCTGTCATTAGATCACAGAGTGCTTGACGGTCTCGTGTGCGGACGATTCCTCGGACGAGTGAAACAAATTTTAGAATCGATTGACGAGAAGACATCTGTTTACTAA

SEQ ID NO: 47 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 48 - protein, 1425 aa, Bacillus subtilis
ATGGCAACTGAGTATGACGTAGTCATTCTGGGCGGCGGTACCGGCGGTTATGTTGCGGCCATCAGAGCCGCTCAGCTCGGCTTAAAAACAGCCGTTGTGGAAAAGGAAAAACTCGGGGGAACATGTCTGCATAAAGGCTGTATCCCGAGTAAAGCGCTGCTTAGAAGCGCAGAGGTATACCGGACAGCTCGTGAAGCCGATCAATTCGGAGTGGAAACGGCTGGCGTGTCCCTCAACTTTGAAAAAGTGCAGCAGCGTAAGCAAGCCGTTGTTGATAAGCTTGCAGCGGGTGTAAATCATTTAATGAAAAAAGGAAAAATTGACGTGTACACCGGATATGGACGTATCCTTGGACCGTCAATCTTCTCTCCGCTGCCGGGAACAATTTCTGTTGAGCGGGGAAATGGCGAAGAAAATGACATGCTGATCCCGAAACAAGTGATCATTGCAACAGGATCAAGACCGAGAATGCTTCCGGGTCTTGAAGTGGACGGTAAGTCTGTACTGACTTCAGATGAGGCGCTCCAAATGGAGGAGCTGCCACAGTCAATCATCATTGTCGGCGGAGGGGTTATCGGTATCGAATGGGCGTCTATGCTTCATGATTTTGGCGTTAAGGTAACGGTTATTGAATACGCGGATCGCATATTGCCGACTGAAGATCTAGAGATTTCAAAAGAAATGGAAAGTCTTCTTAAGAAAAAAGGCATCCAGTTCATAACAGGGGCAAAAGTGCTGCCTGACACAATGACAAAAACATCAGACGATATCAGCATACAAGCGGAAAAAGACGGAGAAACCGTTACCTATTCTGCTGAGAAAATGCTTGTTTCCATCGGCAGACAGGCAAATATCGAAGGCATCGGCCTAGAGAACACCGATATTGTTACTGAAAATGGCATGATTTCAGTCAATGAAAGCTGCCAAACGAAGGAATCTCATATTTATGCAATCGGAGACGTAATCGGTGGCCTGCAGTTAGCTCACGTTGCTTCACATGAGGGAATTATTGCTGTTGAGCATTTTGCAGGTCTCAATCCGCATCCGCTTGATCCGACGCTTGTGCCGAAGTGCATTTACTCAAGCCCTGAAGCTGCCAGTGTCGGCTTAACCGAAGACGAAGCAAAGGCGAACGGGCATAATGTCAAAATCGGCAAGTTCCCATTTATGGCGATTGGAAAAGCGCTTGTATACGGTGAAAGCGACGGTTTTGTCAAAATCGTGGCTGACCGAGATACAGATGATATTCTCGGCGTTCATATGATTGGCCCGCATGTCACCGACATGATTTCTGAAGCGGGTCTTGCCAAAGTGCTGGACGCAACACCGTGGGAGGTCGGGCAAACGATTCACCCGCATCCAACGCTTTCTGAAGCAATTGGAGAAGCTGCGCTTGCCGCAGATGGCAAAGCCATTCATTTTTAA

SEQ ID NO: 49 - protein, 410 aa, Pseudomonas putida
MNEYAPLRLHVPEPTGRPGCQTDFSYLRLNDAGQARKPPVDVDAADTADLSYSLVRVLDEQGDAQGPWAEDIDPQILRQGMRAMLKTRIFDSRMVVAQRQKKMSFYMQSLGEEAIGSGQALALNRTDMCFPTYRQQSILMARDVSLVEMICQLLSNERDPLKGRQLPIMYSVREAGFFTISGNLATQFVQAVGWAMASAIKGDTKIASAWIGDGATAESDFHTALTFAHVYRAPVILNVVNNQWAISTFQAIAGGESTTFAGRGVGCGIASLRVDGNDFVAVYAASRWAAERARRGLGPSLIEWVTYRAGPHSTSDDPSKYRPADDWSHFPLGDPIARLKQHLIKIGHWSEEEHQATTAEFEAAVIAAQKEAEQYGTLANGHIPSAASMFEDVYKEMPDHLRRQRQELGV

SEQ ID NO: 50 - DNA, 6643 bp, Pseudomonas putida
gcatgcctgcaggccgccgatgaaatggtggaaggtatcggtaggctggccctgctcatcgctgaacacgttacgcccgctgccggtatcgaccaggctctggtgaatatgcatggaactgccaggcgtgcgcgccagcggtttggccatgcacaccacggtcagcccgtgcttgagtgccacttccttgagcaggtgtttgaacaggaaggtctggtcggccagcagcagcgggtcgccatgtagcaagttgatctcgaactggctgacgcccatttcgtgcatgaaggtgtcgcgcggcaggccgagcgcggccatgcactggtacacctcattgaagaacgggcgcaggccgttgttggaactgacactgaacgccgaatggcccagctcgcggcggccgtcggtgcccagcggtggctggaacggctgctgcgggtcactgttgggggcaaacacgaagaactcaagctcggtcgccactaccggtgccagacccaacgctgcgtagcgggcgatcacggccttcagctggccccgggtggacagtgccgagggccggccatccagttcattggcatcgcagatggccagggcgcgaccgtcatcgctccagggcaagcgatgaacctggctgggttccgctaccaacgccaggtcgccgtcgtcgcagccgtagaatttcgccggcgggtagccgcccatgatgcattgcagcagcaccccacgggccatctgcaggcggcggccttcgagaaagccttcggcggtcatcaccttgccgcgtgggacgccgttgaggtcgggggtgacgcattcgatttcatcgatgccctggagctgagcgatgctcatgacgcttgtccttgttgttgtaggctgacaacaacataggctgggggtgtttaaaatatcaagcagcctctcgaacgcctggggcctcttctattcgcgcaaggtcatgccattggccggcaacggcaaggctgtcttgtagcgcacctgtttcaaggcaaaactcgagcggatattcgccacacccggcaaccgggtcaggtaatcgagaaaccgctccagcgcctggatactcggcagcagtacccgcaacaggtagtccgggtcgcccgtcatcaggtagcactccatcacctcgggccgttcggcaatttcttcctcgaagcggtgcagcgactgctctacctgtttttccaggctgacatggatgaacacattcacatccagccccaacgcctcgggcgacaacaaggtcacctgctggcggatcacccccagttcttccatggcccgcacccggttgaaacagggcgtgggcgacaggttgaccgagcgtgccagctcggcgttggtgatgcgggcgttttcctgcaggctgttgagaatgccgatatcggtacgatcgagtttgcgcatgagacaaaatcaccggttttttgtgtttatgcggaatgtttatctgccccgctcggcaaaggcaatcaacttgagagaaaaattctcctgccggaccactaagatgtaggggacgctgacttaccagtcacaagccggtactcagcggcggccgcttcagagctcacaaaaacaaatacccgagcgagcgtaaaaagcatgaacgagtacgcccccctgcgtttgcatgtgcccgagcccaccggccggccaggctgccagaccgatttttcctacctgcgcctgaacgatgcaggtcaagcccgtaaaccccctgtcgatgtcgacgctgccgacaccgccgacctgtcctacagcctggtccgcgtgctcgacgagcaaggcgacgcccaaggcccgtgggctgaagacatcgacccgcagatcctgcgccaaggcatgcgcgccatgctcaagacgcggatcttcgacagccgcatggtggttgcccagcgccagaagaagatgtccttctacatgcagagcctgggcgaagaagccatcggcagcggccaggcgctggcgcttaaccgcaccgacatgtgcttccccacctaccgtcagcaaagcatcctgatggcccgcgacgtgtcgctggtggagatgatctgccagttgctgtccaacgaacgcgaccccctcaagggccgccagctgccgatcatgtactcggtacgcgaggccggcttcttcaccatcagcggcaacctggcgacccagttcgtgcaggcggtcggctgggccatggcctcggcgatcaagggcgataccaagattgcctcggcctggatcggcgacggcgccactgccgaatcggacttccacaccgccctcacctttgcccacgtttaccgcgccccggtgatcctcaacgtggtcaacaaccagtgggccatctcaaccttccaggccatcgccggtggcgagtcgaccaccttcgccggccgtggcgtgggctgcggcatcgcttcgctgcgggtggacggcaacgacttcgtcgccgtttacgccgcttcgcgctgggctgccgaacgtgcccgccgtggtttgggcccgagcctgatcgagtgggtcacctaccgtgccggcccgcactcgacctcggacgacccgtccaagtaccgccctgccgatgactggagccacttcccgctgggtgacccgatcgcccgcctgaagcagcacctgatcaagatcggccactggtccgaagaagaacaccaggccaccacggccgagttcgaagcggccgtgattgctgcgcaaaaagaagccgagcagtacggcaccctggccaacggtcacatcccgagcgccgcctcgatgttcgaggacgtgtacaaggagatgcccgaccacctgcgccgccaacgccaggaactgggggtttgagatgaacgaccacaacaacagcatcaacccggaaaccgccatggccaccactaccatgaccatgatccaggccctgcgctcggccatggatgtcatgcttgagcgcgacgacaatgtggtggtgtacggccaggacgtcggctacttcggcggcgtgttccgctgcaccgaaggcctgcagaccaagtacggcaagtcccgcgtgttcgacgcgcccatctctgaaagcggcatcgtcggcaccgccgtgggcatgggtgcctacggcctgcgcccggtggtggaaatccagttcgctgactacttctacccggcctccgaccagatcgtttctgaaatggcccgcctgcgctaccgttcggccggcgagttcatcgccccgctgaccctgcgtatgccctgcggtggcggtatctatggcggccagacacacagccagagcccggaagcgatgttcactcaggtgtgcggcctgcgcaccgtaatgccatccaacccgtacgacgccaaaggcctgctgattgcctcgatcgaatgcgacgacccggtgatcttcctggagcccaagcgcctgtacaacggcccgttcgacggccaccatgaccgcccggttacgccgtggtcgaaacacccgcacagcgccgtgcccgatggctactacaccgtgccactggacaaggccgccatcacccgccccggcaatgacgtgagcgtgctcacctatggcaccaccgtgtacgtggcccaggtggccgccgaagaaagtggcgtggatgccgaagtgatcgacctgcgcagcctgtggccgctagacctggacaccatcgtcgagtcggtgaaaaagaccggccgttgcgtggtagtacacgaggccacccgtacttgtggctttggcgcagaactggtgtcgctggtgcaggagcactgcttccaccacctggaggcgccgatcgagcgcgtcaccggttgggacaccccctaccctcacgcgcaggaatgggcttacttcccagggccttcgcgggtaggtgcggcattgaaaaaggtcatggaggtctgaatgggcacgcacgtcatcaagatgccggacattggcgaaggcatcgcgcaggtcgaattggtggaatggttcgtcaaggtgggcgacatcatcgccgaggaccaagtggtagccgacgtcatgaccgacaaggccaccgtggaaatcccgtcgccggtcagcggcaaggtgctggccctgggtggccagccaggtgaagtgatggcggtcggcagtgagctgatccgcatcgaagtggaaggcagcggcaaccatgtggatgtgccgcaagccaagccggccgaagtgcctgcggcaccggtagccgctaaacctgaaccacagaaagacgttaaaccggcggcgtaccaggcgtcagccagccacgaggcagcgcccatcgtgccgcgccagccgggcgacaagccgctggcctcgccggcggtgcgcaaacgcgccctcgatgccggcatcgaattgcgttatgtgcacggcagcggcccggccgggcgcatcctgcacgaagacctcgacgcgttcatgagcaaaccgcaaagcgctgccgggcaaacccccaatggctatgccaggcgcaccgacagcgagcaggtgccggtgatcggcctgcgccgcaagatcgcccagcgcatgcaggacgccaagcgccgggtcgcgcacttcagctatgtggaagaaatcgacgtcaccgccctggaagccctgcgccagcagctcaacagcaagcacggcgacagccgcggcaagctgacactgctgccgttcctggtgcgcgccctggtcgtggcactgcgtgacttcccgcagataaacgccacctacgatgacgaagcgcagatcatcacccgccatggcgcggtgcatgtgggcatcgccacccaaggtgacaacggcctgatggtacccgtgctgcgccacgccgaagcgggcagcctgtgggccaatgccggtgagatttcacgcctggccaacgctgcgcgcaacaacaaggccagccgcgaagagctgtccggttcgaccattaccctgaccagcctcggcgccctgggcggcatcgtcagcacgccggtggtcaacaccccggaagtggcgatcgtcggtgtcaaccgcatggttgagcggcccgtggtgatcgacggccagatcgtcgtgcgcaagatgatgaacctgtccagctcgttcgaccaccgcgtggtcgatggcatggacgccgccctgttcatccaggccgtgcgtggcctgctcgaacaacccgcctgcctgttcgtggagtgagcatgcaacagactatccagacaaccctgttgatcatcggcggcggccctggcggctatgtggcggccatccgcgccgggcaactgggcatccctaccgtgctggtggaaggccaggcgctgggcggtacctgcctgaacatcggctgcattccgtccaaggcgctgatccatgtggccgagcagttccaccaggcctcgcgctttaccgaaccctcgccgctgggcatcagcgtggcttcgccacgcctggacatcggccagagcgtggcctggaaagacggcatcgtcgatcgcctgaccactggtgtcgccgccctgctgaaaaagcacggggtgaaggtggtgcacggctgggccaaggtgcttgatggcaagcaggtcgaggtggatggccagcgcatccagtgcgagcacctgttgctggccacgggctccagcagtgtcgaactgccgatgctgccgttgggtgggccggtgatttcctcgaccgaggccctggcaccgaaagccctgccgcaacacctggtggtggtgggcggtggctacatcggcctggagctgggtatcgcctaccgcaagctcggcgcgcaggtcagcgtggtggaagcgcgcgagcgcatcctgccgacttacgacagcgaactgaccgccccggtggccgagtcgctgaaaaagctgggtatcgccctgcaccttggccacagcgtcgaaggttacgaaaatggctgcctgctggccaacgatggcaagggcggacaactgcgcctggaagccgaccgggtgctggtggccgtgggccgccgcccacgcaccaagggcttcaacctggaatgcctggacctgaagatgaatggtgccgcgattgccatcgacgagcgctgccagaccagcatgcacaacgtctgggccatcggcgacgtggccggcgaaccgatgctggcgcaccgggccatggcccagggcgagatggtggccgagatcatcgccggcaaggcacgccgcttcgaacccgctgcgatagccgccgtgtgcttcaccgacccggaagtggtcgtggtcggcaagacgccggaacaggccagtcagcaaggcctggactgcatcgtcgcgcagttcccgttcgccgccaacggccgggccatgagcctggagtcgaaaagcggtttcgtgcgcgtggtcgcgcggcgtgacaaccacctgatcctgggctggcaagcggttggcgtggcggtttccgagctgtccacggcgtttgcccagtcgctggagatgggtgcctgcctggaggatgtggccggtaccatccatgcccacccgaccctgggtgaagcggtacaggaagcggcactgcgtgccctgggccacgccctgcatatctgacactgaagcggccgaggccgatttggcccgccgcgccgagaggcgctgcgggtcttttttatacctg

SEQ ID NO: 51 - protein, 352 aa, Pseudomonas putida
MNDHNNSINPETAMATTTMTMIQALRSAMDVMLERDDNVVVYGQDVGYFGGVFRCTEGLQTKYGKSRVFDAPISESGIVGTAVGMGAYGLRPVVEIQFADYFYPASDQIVSEMARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVSVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 52 - DNA, 6643 bp, Pseudomonas putida; identical to SEQ ID NO: 50

SEQ ID NO: 53 - protein, 423 aa, Pseudomonas putida
MGTHVIKMPDIGEGIAQVELVEWFVKVGDIIAEDQVVADVMTDKATVEIPSPVSGKVLALGGQPGEVMAVGSELIRIEVEGSGNHVDVPQAKPAEVPAAPVAAKPEPQKDVKPAAYQASASHEAAPIVPRQPGDKPLASPAVRKRALDAGIELRYVHGSGPAGRILHEDLDAFMSKPQSAAGQTPNGYARRTDSEQVPVIGLRRKIAQRMQDAKRRVAHFSYVEEIDVTALEALRQQLNSKHGDSRGKLTLLPFLVRALVVALRDFPQINATYDDEAQIITRHGAVHVGIATQGDNGLMVPVLRHAEAGSLWANAGEISRLANAARNNKASREELSGSTITLTSLGALGGIVSTPVVNTPEVAIVGVNRMVERPVVIDGQIVVRKMMNLSSSFDHRVVDGMDAALFIQAVRGLLEQPACLFVE

SEQ ID NO: 54 - DNA, 6643 bp, Pseudomonas putida; identical to SEQ ID NO: 50

SEQ ID NO: 55 - protein, 459 aa, Pseudomonas putida
MQQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 56 - DNA, 6643 bp, Pseudomonas putida; identical to SEQ ID NO: 50

SEQ ID NO: 57 - protein, 468 aa, Clostridium beijerinckii
MNKDTLIPTTKDLKLKTNVENINLKNYKDNSSCFGVFENVENAINSAVHAQKILSLHYTKEQREKIITEIRKAALENKEVLATMILEETHMGRYEDKILKHELVAKYTPGTEDLTTTAWSGDNGLTVVEMSPYGVIGAITPSTNPTETVICNSIGMIAAGNAVVFNGHPGAKKCVAFAIEMINKAIISCGGPENLVTTIKNPTMESLDAIIKHPLIKLLCGTGGPGMVKTLLNSGKKAIGAGAGNPPVIVDDTADIEKAGKSIIEGCSFDNNLPCIAEKEVFVFENVADDLISNMLKNNAVIINEDQVSKLIDLVLQKNNETQEYFINKKWVGKDAKLFSDEIDVESPSNIKCIVCEVNANHPFVMTELMMPILPIVRVKDIDEAVKYTKIAEQNRKHSAYIYSKNIDNLNRFEREIDTTIFVKNAKSFAGVGYEAEGFTTFTIAGSTGEGITSARNFTRQRRCVLAG

SEQ ID NO: 58 - DNA, 6558 bp, Clostridium beijerinckii
aagcttaaaatatccataggctattgttaataagactatagcgcttaatactctaagcgcaccatctaaaaaattatacataggaattggataaactccaatcttctccataatacttttcataggtgaaattgatattataattaaggctgcataaagcaaactcatatctccaataaatgtcactatcataggtaatttccttttcatgttcacatactcccccgtattctataataatttacaataaacttccatcacaaataaattataacatatattgtaaatatagttttattattcgcatatttatagataaacaatatataacttagacttatgcaataacctaccgaaagtaaaaacattgttatttcacaggactatgaaaatttcgctgaaagtactaaattgcaggttgcaccactaatgcttgctcccaatttcattgtgacaagcattagttgaacaacctacaattaagagcctttaacagctcatttccaatgcctgctacataaaaatgtttctactttctaatatggtatttacttcaaagtgtaaatcaaattcttaagttgtttatctatatagggttccatattgataacaatacatatctactgtttcaatttcatgaataccagcgatattgaaattttgtaagtttgaatatcattgtgaaaccctatatatcaaatacaatctcaaaattatacaaaaagatcccaacttcacaatatgaatttgagatcttctatcttaacttcttcaatatttttaagattatttatactgcgtgcaaatcttctataagtatcaattatcagctatgtacattgatagtggacttgtaatctgaacagcttatatatttacacttttaagttctcttccactaacccctgctttgaaacttctcataaacaaatcgaaagtacctttaattagctgtgcattctcaaactcagaatttaacttaagtacttcaattgccgcttcgatagtatagagctctccttctgaagcaccttttcttaaagtatattctgatttattaattggatttaatgaaattcttggaagcttctttaagtagtcgctctttcttagtatcttctctgcttctttccatgtgccatctaagataataaatgctggaattttttctgaatctttacatttagactttctttctagaggttcatcatcatccataggaaataatacacgtatttcataatcatcgctattaatatattcaattaatttttcaggagtctttactctctcccaaagaattaactcagttgattctggattcaccaatttcaataatctagcggtatttgaaggcctactaaattctctttctgttgataatatcaatatctttgcttttgtctctattttaggcacaatatcgcagatacaatttattattggcaacccacatttattgcagctctcatataacttagtaatttgcttaactttaaattcagactccattttacctccattattagttggttagtgtgtcatatcttcttgctattactaactgattataacatatgtattcaatatatcactcctagttttcaaagcactggcaatacgaattacaaattaatttctggatttatgtcagtatttcattaataaaaggtcggacttttaagatacttgttttagctattgatcatatttattaaagactatgcatttaatgtataattataatgaatattatcaataatatttattttatattacaatcttacagtctttattctaaatttcactcaaataccaaacgagctttattcataaacaatatataacaataattccaaaataatacgatattttatctgtaacagccatataaaaaaaatatcatatagtcttgtcatttgataacgttttgtcttccttatatttactttttcggtttaataggttgattctgtaaattttagtgataacatatatttgatgacattaaaaatttaatatttcatataaatttttaatgtctattaatttttaaatcacaaggaggaatagttcatgaataaagacacactaatacctacaactaaagatttaaaattaaaaacaaatgttgaaaacattaatttaaagaactacaaggataattcttcatgtttcggagtattcgaaaatgttgaaaatgctataaacagcgctgtacacgcgcaaaagatattatcccttcattatacaaaagaacaaagagaaaaaatcataactgagataagaaaggccgcattagaaaataaagaggttttagctaccatgattctggaagaaacacatatgggaaggtatgaagataaaatattaaagcatgaattagtagctaaatatactcctggtacagaagatttaactactactgcttggtcaggtgataatggtcttacagttgtagaaatgtctccatatggcgttataggtgcaataactccttctacgaatccaactgaaactgtaatatgtaatagcatcggcatgatagctgctggaaatgctgtagtatttaacggacacccaggcgctaaaaaatgtgttgcttttgctattgaaatgataaataaagcaattatttcatgtggcggtcctgagaatttagtaacaactataaaaaatccaactatggaatccctagatgcaattattaagcatcctttaataaaacttctttgcggaactggaggtccaggaatggtaaaaaccctcttaaattctggcaagaaagctataggtgctggtgctggaaatccaccagttattgtagatgataccgctgatatagaaaaggctggtaagagtatcattgaaggctgttcttttgataataatttaccttgtattgcagaaaaagaagtatttgtttttgagaatgttgcagatgatttaatatctaacatgctaaaaaataatgctgtaattataaatgaagatcaagtatcaaaattaatagatttagtattacaaaaaaataatgaaactcaagaatactttataaacaaaaaatgggtaggaaaagatgcaaaattattctcagatgaaatagatgttgagtctccttcaaatattaaatgcatagtctgcgaagtaaatgcaaatcatccatttgtcatgacagaactcatgatgccaatattaccaattgtaagagttaaagatatagatgaagctgttaaatatacaaagatagcagaacaaaatagaaaacatagtgcctatatttattctaaaaatatagacaacctaaatagatttgaaagagaaattgatactactatttttgtaaagaatgctaaatcttttgctggtgttggttatgaagctgaaggatttacaactttcactattgctggatctactggtgaaggcataacctctgcaagaaattttacaagacaaagaagatgtgtacttgccggctaacttcttgctaaatttatacatttattcacataactttaatatgcaatgttcccacaaaatattaaaaactatttagaagggagatattaaatgaataaattagtaaaattaacagatttaaagcgcattttcaaagatggtatgacaattatggttgggggttttttagattgtggaactcctgaaaatattatagatatgctagttgatttaaatataaaaaatctgactattataagcaatgatacagcttttcctaataaaggaataggaaaacttattgtaaatggtcaagtttctaaagtaattgcttcacatattggaactaatcctgaaactgggaaaaaaatgagctctggtgaacttaaagttgagctttctccacaaggaacactgatcgaaagaattcgtgcagctggatctggactcggaggtgtattaactccaaccggacttgggactatcgttgaagaaggtaagaaaaaagttactatcggtggcaaagaatatctattagaacttcctttatccgctgatgtttcattaataaaaggtagcattgtagatgaatttggaaataccttctatagagctgctactaaaaatttcaatccatatatggcaatggctgcaaaaacagttatagttgaagcagaaaatttagttaaatgtgaagatttaaaaagagatgccataatgactcctggcgtattagtagattatatcgttaaggaggcggcttaattgattgtagataaagttttagcaaaagagataattgccaaaagagttgcaaaagaactaaaaaaaggccaactcgtaaaccttggaataggacttccaactttagtagctaattatgtgccaaaagaaatgaacattactttcgaatcagaaaatggcatggttggcatggcacaaatggcctcatcaggtgaaaatgacccagatataataaatgctggtggggaatatgtaacattattacctcaaggtgcattttttgatagttcaacgtcttttgcactaataagaggaggacatgttgatgttgctgttcttggtgctctagaagttgatgaagaaggtaatttagctaactggattgttccaaataaaattgtcccaggtatgggaggcgccatggatttggcaataggcgcaaaaaaaataatagtggcaatgcaacatacaggaaaaggtaaacctaaaatcgtaaaaaaatgtactctcccacttactgctaaggctcaggtagatttaattgttacagaactttgtgtaattgatgtaacaaatgatggtttacttttcagagaaattcataaagatacaactattgatgaaataaaatttttaacagatgcagatttaattattcccgacaacttaaaaattatggatatctaaatcattctattttaaatatataactttaaaaatcttatgtattaaaaactaagaaaagaggttgattattttatgttagaaagtgaagtatctaaacaaattacaactccacttgctgctccagcgtttcctagaggaccatatagatttcacaatagagaatatctaaacattatttatcgaactgatttagatgctcttcgaaaaatagtaccagagccacttgaattagatggagcatatgttaggtttgagatgatggctatgcctgatacaaccggactaggctcatatactgagtgtggtcaagccattccagtaaaatataatgaggttaaaggtgactacttgcatatgatgtacctagataatgaacctgctattgctgttggaagagaaagcagtgcttatcccaaaaagttcggctatccaaagctatttgttgattcagacgccctagttggcgcccttaagtatggtgcattaccggtagttactgcgacgatgggatataagcatgagcccctagatcttaaagaagcctatactcaaattgcaagacccaatttcatgctaaaaatcattcaaggttatgatggtaagccaagaatttgtgaactcatctgtgcagaaaatactgatataactatccacggtgcttggactggaagtgcacgcctacaattatttagccatgcactagctcctcttgctgatttacctgtattagagatcgtatcagcatctcatatcctaacagatttaactcttggaacacctaaggttgtacatgattatctttcagtaaaataaaagcaatatagaataaccactacaaaagtagtggttattctatattttaaatcaaactgtaaaacttaagttttatagtacctaataatattttactaccagcattagattagttaaaatacaaagtttgtggtaaaagtattttagattgcataatagccttctatacttttaacaatataaccaattgctcaccatctgcttagaatatgcttctttaagctctaaaatacatataaaaaagtaggaatttcttattaaaattcctacttatattatatataaatttaatcgttaggttttattcgcattgttcctctttaatttatctcttataacattttattataattgttcatataattaattcaatatactattatatattttcaagcattaataattattcagcatctgtcattacatatgcttccatactttgacttcttattaaatcatagctaatccatccatagccattgattccccagtctttaccccatgaatttattatttttacagcttttttactatcatcataaccaactacgcaaactgcatgaccacctctattttctccatcaatctggtcataaattggattatcagaatttaaattatcaaaatctggatatactgatattccaataactactggatttccagctgctatttgtgcctttattgcattatagtcaccatctggaagttgactccaactttttgctttatatttggctgcattagccttttgttcatctgtaggtgtaacctcccaactatattcactaccatcataaggcatatcagataatgtagtacaaccttgttcttctaataatttaaatgcat

SEQ ID NO: 59 - protein, 862 aa, Clostridium acetobutylicum
MKVTTVKELDEKLKVIKEAQKKFSCYSQEMVDEIFRNAAMAAIDARIELAKAAVLETGMGLVEDKVIKNHFAGEYIYNKYKDEKTCGIIERNEPYGITKIAEPIGVVAAIIPVTNPTSTTIFKSLISLKTRNGIFFSPHPRAKKSTILAAKTILDAAVKSGAPENIIGWIDEPSIELTQYLMQKADITLATGGPSLVKSAYSSGKPAIGVGPGNTPVIIDESAHIKMAVSSIILSKTYDNGVICASEQSVIVLKSIYNKVKDEFQERGAYIIKKNELDKVREVIFKDGSVNPKIVGQSAYTIAAMAGIKVPKTTRILIGEVTSLGEEEPFAHEKLSPVLAMYEADNFDDALKKAVTLINLGGLGHTSGIYADEIKARDKIDRFSSAMKTVRTFVNIPTSQGASGDLYNFRIPPSFTLGCGFWGGNSVSENVGPKHLLNIKTVAERRENMLWFRVPHKVYFKFGCLQFALKDLKDLKKKRAFIVTDSDPYNLNYVDSIIKILEHLDIDFKVFNKVGREADLKTIKKATEEMSSFMPDTIIALGGTPEMSSAKLMWVLYEHPEVKFEDLAIKFMDIRKRIYTFPKLGKKAMLVAITTSAGSGSEVTPFALVTDNNTGNKYMLADYEMTPNMAIVDAELMMKMPKGLTAYSGIDALVNSIEAYTSVYASEYTNGLALEAIRLIFKYLPEAYKNGRTNEKAREKMAHASTMAGMASANAFLGLCHSMAIKLSSEHNIPSGIANALLIEEVIKFNAVDNPVKQAPCPQYKYPNTIFRYARIADYIKLGGNTDEEKVDLLINKIHELKKALNIPTSIKDAGVLEENFYSSLDRISELALDDQCTGANPRFPLTSEIKEMYINCFKKQP

SEQ ID NO: 60 - DNA, 1665 bp, Clostridium acetobutylicum; identical to SEQ ID NO: 30

SEQ ID NO: 61 - protein, 858 aa, Clostridium acetobutylicum
MKVTNQKELKQKLNELREAQKKFATYTQEQVDKIFKQCAIAAAKERINLAKLAVEETGIGLVEDKIIKNHFAAEYIYNKYKNEKTCGIIDHDDSLGITKVAEPIGIVAAIVPTTNPTSTAIFKSLISLKTRNAIFFSPHPRAKKSTIAAAKLILDAAVKAGAPKNIIGWIDEPSIELSQDLMSEADIILATGGPSMVKAAYSSGKPAIGVGAGNTPAIIDESADIDMAVSSIILSKTYDNGVICASEQSILVMNSIYEKVKEEFVKRGSYILNQNEIAKIKETMFKNGAINADIVGKSAYIIAKMAGIEVPQTTKILIGEVQSVEKSELFSHEKLSPVLAMYKVKDFDEALKKAQRLIELGGSGHTSSLYIDSQNNKDKVKEFGLAMKTSRTFINMPSSQGASGDLYNFAIAPSFTLGCGTWGGNSVSQNVEPKHLLNIKSVAERRENMLWFKVPQKIYFKYGCLRFALKELKDMNKKRAFIVTDKDLFKLGYVNKITKVLDEIDIKYSIFTDIKSDPTIDSVKKGAKEMLNFEPDTIISIGGGSPMDAAKVMHLLYEYPEAEIENLAINFMDIRKRICNFPKLGTKAISVAIPTTAGTGSEATPFAVITNDETGMKYPLTSYELTPNMAIIDTELMLNMPRKLTAATGIDALVHAIEAYVSVMATDYTDELALRAIKMIFKYLPRAYKNGTNDIEAREKMAHASNIAGMAFANAFLGVCHSMAHKLGAMHHVPHGIACAVLIEEVIKYNATDCPTKQTAFPQYKSPNAKRKYAEIAEYLNLKGTSDTEKVTALIEAISKLKIDLSIPQNISAAGINKKDFYNTLDKMSELAFDDQCTTANPRYPLISELKDIYIKSF

SEQ ID NO: 62 - DNA, 2589 bp, Clostridium acetobutylicum
atgaaagtcacaacagtaaaggaattagatgaaaaactcaaggtaattaaagaagctcaaaaaaaattctcttgttactcgcaagaaatggttgatgaaatctttagaaatgcagcaatggcagcaatcgacgcaaggatagagctagcaaaagcagctgttttggaaaccggtatgggcttagttgaagacaaggttataaaaaatcattttgcaggcgaatacatctataacaaatataaggatgaaaaaacctgcggtataattgaacgaaatgaaccctacggaattacaaaaatagcagaacctataggagttgtagctgctataatccctgtaacaaaccccacatcaacaacaatatttaaatccttaatatcccttaaaactagaaatggaattttcttttcgcctcacccaagggcaaaaaaatccacaatactagcagctaaaacaatacttgatgcagccgttaagagtggtgccccggaaaatataataggttggatagatgaaccttcaattgaactaactcaatatttaatgcaaaaagcagatataacccttgcaactggtggtccctcactagttaaatctgcttattcttccggaaaaccagcaataggtgttggtccgggtaacaccccagtaataattgatgaatctgctcatataaaaatggcagtaagttcaattatattatccaaaacctatgataatggtgttatatgtgcttctgaacaatctgtaatagtcttaaaatccatatataacaaggtaaaagatgagttccaagaaagaggagcttatataataaagaaaaacgaattggataaagtccgtgaagtgatttttaaagatggatccgtaaaccctaaaatagtcggacagtcagcttatactatagcagctatggctggcataaaagtacctaaaaccacaagaatattaataggagaagttacctccttaggtgaagaagaaccttttgcccacgaaaaactatctcctgttttggctatgtatgaggctgacaattttgatgatgctttaaaaaaagcagtaactctaataaacttaggaggcctcggccatacctcaggaatatatgcagatgaaataaaagcacgagataaaatagatagatttagtagtgccatgaaaaccgtaagaacctttgtaaatatcccaacctcacaaggtgcaagtggagatctatataattttagaataccaccttctttcacgcttggctgcggattttggggaggaaattctgtttccgagaatgttggtccaaaacatcttttgaatattaaaaccgtagctgaaaggagagaaaacatgctttggtttagagttccacataaagtatattttaagttcggttgtcttcaatttgctttaaaagatttaaaagatctaaagaaaaaaagagcctttatagttactgatagtgacccctataatttaaactatgttgattcaataataaaaatacttgagcacctagatattgattttaaagtatttaataaggttggaagagaagctgatcttaaaaccataaaaaaagcaactgaagaaatgtcctcctttatgccagacactataatagctttaggtggtacccctgaaatgagctctgcaaagctaatgtgggtactatatgaacatccagaagtaaaatttgaagatcttgcaataaaatttatggacataagaaagagaatatatactttcccaaaactcggtaaaaaggctatgttagttgcaattacaacttctgctggttccggttctgaggttactccttttgctttagtaactgacaataacactggaaataagtacatgttagcagattatgaaatgacaccaaatatggcaattgtagatgcagaacttatgatgaaaatgccaaagggattaaccgcttattcaggtatagatgcactagtaaatagtatagaagcatacacatccgtatatgcttcagaatacacaaacggactagcactagaggcaatacgattaatatttaaatatttgcctgaggcttacaaaaacggaagaaccaatgaaaaagcaagagagaaaatggctcacgcttcaactatggcaggtatggcatccgctaatgcatttctaggtctatgtcattccatggcaataaaattaagttcagaacacaatattcctagtggcattgccaatgcattactaatagaagaagtaataaaatttaacgcagttgataatcctgtaaaacaagccccttgcccacaatataagtatccaaacaccatatttagatatgctcgaattgcagattatataaagcttggaggaaatactgatgaggaaaaggtagatctcttaattaacaaaatacatgaactaaaaaaagctttaaatataccaacttcaataaaggatgcaggtgttttggaggaaaacttctattcctcccttgatagaatatctgaacttgcactagatgatcaatgcacaggcgctaatcctagatttcctcttacaagtgagataaaagaaatgtatataaattgttttaaaaaacaaccttaa

SEQ ID NO: 63 - protein, 307 aa, Pseudomonas putida
MSKKLKAAIIGPGNIGTDLVMKMLRSEWIEPVWMVGIDPNSDGLKRARDFGMKTTAEGVDGLLPHVLDDDIRIAFDATSAYVHAENSRKLNALGVLMVDLTPAAIGPYCVPPVNLKQHVGRLEMNVNMVTCGGQATIPMVAAVSRVQPVAYAEIVATVSSRSVGPGTRKNIDEFTRTTAGAIEQVGGAREGKAIIVINPAEPPLMMRDTIHCLTDSEPDQAAITASVHAMIAEVQKYVPGYRLKNGPVFDGNRVSIFMEVEGLGDYLPKYAGNLDIMTAAALRTGEMFAEEIAAGTIQLPRRDIALA

SEQ ID NO: 64 - DNA, 2180 bp, Pseudomonas putida
ggtacccctggagccggtcaaggccggcgacttcatgcgcgtcgagatcggcggcatcggcagcgcctccgtgcgcttcacctgatcgaacagaggacaaacccatgagcaagaaactcaaggcggccatcataggccccggcaatatcggtaccgatctggtgatgaagatgctccgttccgagtggattgagccggtgtggatggtcggcatcgaccccaactccgacggcctcaaacgcgcccgcgatttcggcatgaagaccacagccgaaggcgtcgacggcctgctcccgcacgtgctggacgacgacatccgcatcgccttcgacgccacctcggcctatgtgcatgccgagaatagccgcaagctcaacgcgcttggcgtgctgatggtcgacctgaccccggcggccatcggcccctactgcgtgccgccggtcaacctcaagcagcatgtcggccgcctggaaatgaacgtcaacatggtcacctgcggcggccaggccaccatccccatggtcgccgcggtgtcccgcgtgcagccggtggcctacgccgagatcgtcgccaccgtctcctcgcgctcggtcggcccgggcacgcgcaagaacatcgacgagttcacccgcaccaccgccggcgccatcgagcaggtcggcggcgccagggaaggcaaggcgatcatcgtcatcaacccggccgagccgccgctgatgatgcgcgacaccatccactgcctgaccgacagcgagccggaccaggctgcgatcaccgcttcggttcacgcgatgatcgccgaggtgcagaaatacgtgcccggctaccgcctgaagaacggcccggtgttcgacggcaaccgcgtgtcgatcttcatggaagtcgaaggcctgggcgactacctgcccaagtacgccggcaacctcgacatcatgaccgccgccgcgctgcgtaccggcgagatgttcgccgaggaaatcgccgccggcaccattcaactgccgcgtcgcgacatcgcgctggcttgaggagtagcaccatgaatttgcacggcaagagcgtcatcctgcacgacatgagcctgcgcgacggcatgcacgccaagcgccaccagatcagcctggagcagatggtcgcggtcgccaccggcctcgatcaagccggtatgccgctgatcgagatcacccacggcgacggcctcggcggtcgttcgatcaactacggcttcccggcccacagtgacgaggagtacctgcgcgcggtgatcccgcagctcaagcaggccaaagtctcggcgctgctgctgcccggcatcggcaccgtcgaccacctgaagatggccctggactgcggcgtctcgactattcgcgtggccacccactgtaccgaggcggatgtctccgagcagcacatcggcatggcgcgcaagctgggggtcgacaccgtcggcttcctgatgatggcgcacatgatcagcgccgagaaagtcctggagcaggccaagctgatggaaagctatggtgccaactgcatctactgcaccgactcggccggctacatgctgcctgatgaagtcagcgagaaaatcggcctcctgcgcgccgagctgaacccggccaccgaagtcggcttccacggccaccacaacatgggcatggctatcgccaactcgctggccgccatcgaagccggtgccgcgcgcatcgacggctcggtcgccggcctcggcgccggtgccggcaacaccccgctggaagtgttcgtcgcagtgtgcaaacgcatgggcgtggagaccggcatcgacctgtacaagatcatggacgtggccgaggacctggtggtgccgatgatggatcagccgatccgcgtcgaccgcgacgccctgaccctgggctacgccggggtgtacagctcgttcctgctgttcgcccagcgcgccgagaagaaatatggcgtgtcggcccgcgacatcctggtcgaactgggccggcgcggcaccgtcggtggccaggaagacatgatcgaagacctcgccctggacatggcccgggcccgtcagcagcagaaggtgagcgcatgaaccgtaccctgacccgcgaacaggtgctggccctggccgagcacatcgaaaacgccgagctgaatgtccacgacatcggcaaggtgaccaacgattttcc

SEQ ID NO: 65 - protein, 307 aa, Thermus thermophilus
MSERVKVAILGSGNIGTDLMYKLLKNPGHMELVAVVGIDPKSEGLARARALGLEASHEGIAYILERPEIKIVFDATSAKAHVRHAKLLREAGKIAIDLTPAARGPYVVPPVNLKEHLDKDNVNLITCGGQATIPLVYAVHRVAPVLYAEMVSTVASRSAGPGTRQNIDEFTFTTARGLEAIGGAKKGKAIIILNPAEPPILMTNTVRCIPEDEGFDREAVVASVRAMEREVQAYVPGYRLKADPVFERLPTPWGERTVVSMLLEVEGAGDYLPKYAGNLDIMTASARRVGEVFAQHLLGKPVEEVVA

SEQ ID NO: 66 - protein, 924 aa, Thermus thermophilus
ATGTCCGAAAGGGTTAAGGTAGCCATCCTGGGCTCCGGCAACATCGGGACGGACCTGATGTACAAGCTCCTGAAGAACCCGGGCCACATGGAGCTTGTGGCGGTGGTGGGGATAGACCCCAAGTCCGAGGGCCTGGCCCGGGCGCGGGCCTTAGGGTTAGAGGCGAGCCACGAAGGGATCGCCTACATCCTGGAGAGGCCGGAGATCAAGATCGTCTTTGACGCCACCAGCGCCAAGGCCCACGTGCGCCACGCCAAGCTCCTGAGGGAGGCGGGGAAGATCGCCATAGACCTCACGCCGGCGGCCCGGGGCCCTTACGTGGTGCCCCCGGTGAACCTGAAGGAACACCTGGACAAGGACAACGTGAACCTCATCACCTGCGGGGGGCAGGCCACCATCCCCCTGGTCTACGCGGTGCACCGGGTGGCCCCCGTGCTCTACGCGGAGATGGTCTCCACGGTGGCCTCCCGCTCCGCGGGCCCCGGCACCCGGCAGAACATCGACGAGTTCACCTTCACCACCGCCCGGGGCCTGGAGGCCATCGGGGGGGCCAAGAAGGGGAAGGCCATCATCATCCTGAACCCGGCGGAACCCCCCATCCTCATGACCAACACCGTGCGCTGCATCCCCGAGGACGAGGGCTTTGACCGGGAGGCCGTGGTGGCGAGCGTCCGGGCCATGGAGCGGGAGGTCCAGGCCTACGTGCCCGGCTACCGCCTGAAGGCGGACCCGGTGTTTGAGAGGCTTCCCACCCCCTGGGGGGAGCGCACCGTGGTCTCCATGCTCCTGGAGGTGGAGGGGGCGGGGGACTATTTGCCCAAATACGCCGGCAACCTGGACATCATGACGGCTTCTGCCCGGAGGGTGGGGGAGGTCTTCGCCCAGCACCTCCTGGGGAAGCCCGTGGAGGAGGTGGTGGCGTGA

SEQ ID NO: 67 - protein, 417 aa, Escherichia coli
MTFSLFGDKFTRHSGITLLMEDLNDGLRTPGAIMLGGGNPAQIPEMQDYFQTLLTDMLESGKATDALCNYDGPQGKTELLTLLAGMLREKLGWDIEPQNIALTNGSQSAFFYLFNLFAGRRADGRVKKVLFPLAPEYIGYADAGLEEDLFVSARPNIELLPEGQFKYHVDFEHLHIGEETGMICVSRPTNPTGNVITDEELLKLDALANQHGIPLVIDNAYGVPFPGIIFSEARPLWNPNIVLCMSLSKLGLPGSRCGIIIANEKIITAITNMNGIISLAPGGIGPAMMCEMIKRNDLLRLSETVIKPFYYQRVQETIAIIRRYLPENRCLIHKPEGAIFLWLWFKDLPITTKQLYQRLKARGVLMVPGHNFFPGLDKPWPHTHQCMRMNYVPEPEKIEAGVKILAEEIERAWAESH

SEQ ID NO: 68 - protein, 417 aa, Escherichia coli; identical to SEQ ID NO: 67

SEQ ID NO: 69 - protein, 425 aa, Bacillus licheniformis
MKPPLSKIGEKMIEKTGVRAVMSDIQEVLAGGERSYINLSAGNPMILPGVSAMWKSALADLLDDDRFSSVIGQYGSSYGTDELIASVVRFFSERYSAGIRKENVLITAGSQQLFFLAINSFCGMGSGSVMKKALIPMLPDYSGYSGAALEREMIEGIPPLISKLDDHTFRYELDRKGFLERMRIGAVLLSRPNNPCGNILPKEDVAFISDACREANVPLFIDSAYAPPFPAIHFIDMEPIFNEQIIHCMSLSKAGLPGERIGIAIGPSRYIQAMEAFQSNAAIHSSRLGQYMAASVLNDGRLADVSLNEVRPYYRNKFMLLKETLLCKMPEDIKWYLHQGEGSLFGWLWFEDLPVTDAALYEYMKADGVIIVPGSSFFHRQSRRLAHSHQCIRISLTAADEDIIRGIDVLAKIAKGVYEKQVEYL

SEQ ID NO: 70 - protein, 1278 aa, Bacillus licheniformis
TTATAAGTATTCAACCTGTTTCTCATATACACCCTTCGCAATTTTAGCTAAAACATCGATTCCCCTTATAATATCTTCATCCGCCGCGGTTAGGCTGATTCGTATACACTGGTGTGAATGCGCCAGGCGCCGGGATTGACGGTGAAAGAAAGATGATCCGGGAACGATAATGACTCCATCCGCTTTCATATACTCATACAGCGCTGCATCGGTCACCGGCAGGTCTTCAAACCACAGCCATCCGAAAAGCGATCCTTCCCCTTGATGCAGATACCATTTGATGTCTTCAGGCATCTTGCATAAAAGCGTTTCCTTGAGCAGCATGAATTTATTGCGGTAATATGGCCTGACTTCATTCAGCGACACGTCGGCGAGGCGCCCGTCATTCAATACTGATGCAGCCATATACTGCCCCAGCCTTGAAGAATGGATCGCCGCATTCGACTGAAAAGCTTCCATTGCCTGAATATACCGGGACGGCCCGATGGCGATTCCGATCCTTTCGCCAGGCAGGCCGGCTTTTGAAAGGCTCATACAGTGAATGATCTGCTCGTTGAAAATCGGTTCCATGTCGATAAAGTGAATCGCCGGAAAAGGCGGAGCATATGCGGAATCAATGAACAGCGGAACATTCGCTTCTCGGCATGCGTCTGAAATGAATGCTACATCTTCTTTAGGCAAGATGTTTCCGCAAGGATTGTTCGGGCGCGATAGCAAGACAGCACCGATGCGCATCCTCTCTAAAAACCCCTTACGGTCGAGCTCATATCGAAACGTATGATCATCCAATTTCGATATGAGCGGAGGGATCCCCTCAATCATCTCCCGCTCCAGTGCCGCCCCGCTGTATCCCGAATAGTCAGGCAGCATCGGGATCAAGGCTTTTTTCATCACAGATCCGCTTCCCATTCCGCAAAACGAATTGATCGCCAGAAAAAACAGCTGCTGGCTTCCGGCTGTAATCAACACGTTCTCTTTTCGAATGCCGGCGCTATACCGCTCTGAAAAGAAGCGGACAACACTTGCAATCAGTTCATCGGTTCCATAGCTCGATCCGTATTGGCCGATCACCGAAGAAAACCTGTCATCGTCAAGGAGATCGGCAAGAGCCGACTTCCACATGGCTGACACGCCGGGCAAAATCATCGGATTGCCCGCACTTAAATTAATGTATGACCGTTCACCGCCGGCCAGGACTTCCTGAATATCGCTCATCACAGCCCTGACCCCTGTTTTCTCAATCATTTTCTCTCCGATTTTGCTTAATGGCGGCTTCAC

SEQ ID NO: 71 - protein, 309 aa, Escherichia coli
MTTKKADYIWFNGEMVRWEDAKVHVMSHALHYGTSVFEGIRCYDSHKGPVVFRHREHMQRLHDSAKIYRFPVSQSIDELMEACRDVIRKNNLTSAYIRPLIFVGDVGMGVNPPAGYSTDVIIAAFPWGAYLGAEALEQGIDAMVSSWNRAAPNTIPTAAKAGGNYLSSLLVGSEARRHGYQEGIALDVNGYISEGAGENLFEVKDGVLFTPPFTSSALPGITRDAIIKLAKELGIEVREQVLSRESLYLADEVFMSGTAAEITPVRSVDGIQVGEGRCGPVTKRIQQAFFGLFTGETEDKWGWLDQVNQ

SEQ ID NO: 72 - DNA, 1476 bp, Escherichia coli
atggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgattgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaa

SEQ ID NO: 73 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 74 - protein, 376 aa, Saccharomyces cerevisiae; identical to SEQ ID NO: 73

SEQ ID NO: 75 - protein, 330 aa, Methanobacterium thermoautotrophicum
MRLWRALYRPPTITYPSKSPEVIIMSCEASGKIWLNGEMVEWEEATVHVLSHVVHYGSSVFEGIRCYRNSKGSAIFRLREHVKRLFDSAKIYRMDIPYTQEQICDAIVETVRENGLEECYIRPVVFRGYGEMGVHPVNCPVDVAVAAWEWGAYLGAEALEVGVDAGVSTWRRMAPNTMPNMAKAGGNYLNSQLAKMEAVRHGYDEAIMLDYHGYISEGSGENIFLVSEGEIYTPPVSSSLLRGITRDSVIKIARTEGVTVHEEPITREMLYIADEAFFTGTAAEITPIRSVDGIEIGAGRRGPVTKLLQDEFFRIIRAETEDSFGWLTYI

SEQ ID NO: 76 - protein, 993 aa, Methanothermobacter thermautotrophicus
TCAGATGTAGGTGAGCCATCCGAAGCTGTCCTCTGTCTCTGCCCTGATTATCCTGAAGAACTCATCCTGCAGCAGCTTTGTAACGGGACCCCTTCGCCCGGCACCTATCTCTATACCATCAACTGATCTGATGGGTGTTATCTCTGCGGCTGTACCTGTGAAGAAGGCCTCATCTGCGATGTAGAGCATCTCCCTGGTTATGGGTTCCTCATGCACGGTAACACCCTCGGTCCTGGCTATCTTTATTACGGAGTCCCTTGTTATCCCCCTCAGAAGGGATGATGAAACAGGGGGGGTGTAAATTTCACCCTCACTGACGAGGAATATGTTCTCCCCGCTACCCTCACTTATGTAGCCATGGTAGTCCAGCATTATGGCCTCATCATAGCCGTGTCTCACAGCCTCCATCTTGGCAAGCTGTGAGTTGAGGTAGTTACCGCCGGCCTTTGCCATGTTGGGCATTGTGTTTGGTGCCATCCTCCGCCAGGTTGAAACACCAGCATCGACACCAACCTCAAGGGCCTCTGCACCCAGATAGGCCCCCCATTCCCAGGCAGCCACAGCGACGTCCACTGGGCAGTTCACCGGGTGAACACCCATCTCACCGTATCCCCTGAATACCACGGGTCTTATATAGCACTCCTCAAGTCCGTTCTCCCTGACGGTCTCAACTATGGCATCACATATCTGCTCCTGGGTGTAGGGTATGTCCATCCGGTATATCTTTGCAGAATCAAAAAGGCGTTTAACATGCTCCCGCAAACGGAAGATGGCTGACCCCTTACTGTTCCTGTAGCACCTTATTCCCTCAAAGACAGATGATCCATAATGCACAACATGTGAGAGTACGTGGACGGTGGCTTCTTCCCATTCAACCATTTCACCGTTTAACCATATCTTTCCACTGGCTTCGCATGACATGATAATAACCTCAGGTGATTTACTAGGATAGGTTATGGTTGGAGGCCTATATAATGCTCTCCATAACCGCAA

SEQ ID NO: 77 - protein, 364 aa, Streptomyces coelicolor
MTDVNGAPADVLHTLFHSDQGGHEQVVLCQDRASGLKAVIALHSTALGPALGGTRFYPYASEAEAVADALNLARGMSYKNAMAGLDHGGGKAVIIGDPEQIKSEELLLAYGRFVASLGGRYVTACDVGTYVADMDVVARECRWTTGRSPENGGAGDSSVLTSFGVYQGMRAAAQHLWGDPTLRDRTVGIAGVGKVGHHLVEHLLAEGAHVVVTDVRKDVVRGITERHPSVVAVADTDALIRVENLDIYAPCALGGALNDDTVPVLTAKVVCGAANNQLAHPGVEKDLADRGILYAPDYVVNAGGVIQVADELHGFDFDRCKAKASKIYDTTLAIFARAKEDGIPPAAAADRIAEQRMAEARPRP

SEQ ID NO: 78 - DNA, 1095 bp, Streptomyces coelicolor
tcacggccggggacgggcctccgccatccgctgctcggcgatccggtcggccgccgcggccggcggaataccgtcctccttcgcacgtgcgaatatggccagcgtggtgtcgtagatcttcgaggccttcgccttgcaccggtcgaagtcgaacccgtgcagctcgtcggcgacctggatgacaccgccggcgttcaccacatagtccggcgcgtagaggatcccgcggtcggcgaggtccttctcgacgcccgggtgggcgagctggttgttggccgcgccgcacaccaccttggcggtcagcaccggcacggtgtcgtcgttcagcgcgccgccgagcgcgcagggcgcgtagatgtccaggttctccacccggatcagcgcgtcggtgtcggcgacggcgaccaccgacgggtgccgctccgtgatcccgcgcaccacgtccttgcgcacgtccgtgacgacgacgtgggcgccctcggcgagcaggtgctcgaccaggtggtggccgaccttgccgacgcccgcgatgccgacggtgcggtcgcgcagcgtcgggtcgccccacaggtgctgggcggcggcccgcatgccctggtagacgccgaaggaggtgagcacggaggagtcgcccgcgccgccgttctccggggaacgcccggtcgtccagcggcactcgcgggccacgacgtccatgtcggcgacgtaggtgccgacgtcgcacgcggtgacgtagcggccgcccagcgaggcgacgaaccggccgtaggcgaggagcagctcctcgctcttgatctgctccggatcgccgatgatcacggccttgccgccaccgtggtccagaccggccatggcgttcttgtacgacatcccgcgggcgaggttcagcgcgtcggcgacggcctccgcctcgctcgcgtacgggtagaagcgggtaccgccgagcgccgggcccagggcggtggagtggagggcgatcacggccttgaggccgctggcacggtcctggcagagcacgacttgctcatgtcccccctgatccgagtggaacagggtgtgcagtacatcagcaggtgcgccgtttacgtcggtcac

SEQ ID NO: 79 - protein, 364 aa, Bacillus subtilis
MELFKYMEKYDYEQLVFCQDEQSGLKAIIAIHDTTLGPALGGTRMWTYENEEAAIEDALRLARGMTYKNAAAGLNLGGGKTVIIGDPRKDKNEEMFRAFGRYIQGLNGRYITAEDVGTTVEDMDIIHDETDYVTGISPAFGSSGNPSPVTAYGVYRGMKAAAKAAFGTDSLEGKTIAVQGVGNVAYNLCRHLHEEGANLIVTDINKQSVQRAVEDFGARAVDPDDIYSQDCDIYAPCALGATINDDTIKQLKAKVIAGAANNQLKETRHGDQIHEMGIVYAPDYVINAGGVINVADELYGYNAERALKKVEGIYGNIERVLEISQRDGIPAYLAADRLAEERIERMRRSRSQFLQNGHSVLSRR

SEQ ID NO: 80 - protein, 364 aa, Bacillus subtilis; identical to SEQ ID NO: 79

SEQ ID NO: 81 - protein, 594 aa, Streptomyces viridifaciens
MSTSSASSGPDLPFGPEDTPWQKAFSRLRAVDGVPRVTAPSSDPREVYMDIPEIPFSKVQIPPDGMDEQQYAEAESLFRRYVDAQTRNFAGYQVTSDLDYQHLSHYLNRHLNNVGDPYESSSYTLNSKVLERAVLDYFASLWNAKWPHDASDPETYWGYVLTMGSSEGNLYGLWNARDYLSGKLLRRQHREAGGDKASVVYTQALRHEGQSPHAYEPVAFFSQDTHYSLTKAVRVLGIDTFHSIGSSRYPDENPLGPGTPWPTEVPSVDGAIDVDKLASLVRFFASKGYPILVSLNYGSTFKGAYDDVPAVAQAVRDICTEYGLDRRRVYHDRSKDSDFDERSGFWIHIDAALGAGYAPYLQMARDAGMVEEAPPVFDFRLPEVHSLTMSGHKWMGTPWACGVYMTRTGLQMTPPKSSEYIGAADTTFAGSRNGFSSLLLWDYLSRHSYDDLVRLAADCDRLAGYAHDRLLTLQDKLGMDLWVARSPQSLTVRFRQPCADIVRKYSLSCETVYEDNEQRTYVHLYAVPHLTRELVDELVRDLRQPGAFTNAGALEGEAWAGVIDALGRPDPDGTYAGALSAPASGPRSEDGGGS

SEQ ID NO: 82 - DNA, 1785 bp, Streptomyces viridifaciens
gtgtcaacttcctccgcttcttccgggccggacctccccttcgggcccgaggacacgccatggcagaaggccttcagcaggctgcgggcggtggatggcgtgccgcgcgtcaccgcgccgtccagtgatccgcgtgaggtctacatggacatcccggagatccccttctccaaggtccagatccccccggacggaatggacgagcagcagtacgcagaggccgagagcctcttccgccgctacgtagacgcccagacccgcaacttcgcgggataccaggtcaccagcgacctcgactaccagcacctcagtcactatctcaaccggcatctgaacaacgtcggcgatccctatgagtccagctcctacacgctgaactccaaggtccttgagcgagccgttctcgactacttcgcctccctgtggaacgccaagtggccccatgacgcaagcgatccggaaacgtactggggttacgtgctgaccatgggctccagcgaaggcaacctgtacgggttgtggaacgcacgggactatctgtcgggcaagctgctgcggcgccagcaccgggaggccggcggcgacaaggcctcggtcgtctacacgcaagcgctgcgacacgaagggcagagtccgcatgcctacgagccggtggcgttcttctcgcaggacacgcactactcgctcacgaaggccgtgcgggttctgggcatcgacaccttccacagcatcggcagcagtcggtatccggacgagaacccgctgggccccggcactccgtggccgaccgaagtgccctcggttgacggtgccatcgatgtcgacaaactcgcctcgttggtccgcttcttcgccagcaagggctacccgatactggtcagcctcaactacgggtcaacgttcaagggcgcctacgacgacgtcccggccgtggcacaggccgtgcgggacatctgcacggaatacggtctggatcggcggcgggtataccacgaccgcagtaaggacagtgacttcgacgagcgcagcggcttctggatccacatcgatgccgccctgggggcgggctacgctccctacctgcagatggcccgggatgccggcatggtcgaggaggcgccgcccgttttcgacttccggctcccggaggtgcactcgctgaccatgagcggccacaagtggatgggaacaccgtgggcatgcggtgtctacatgacacggaccgggctgcagatgaccccgccgaagtcgtccgagtacatcggggcggccgacaccaccttcgcgggctcccgcaacggcttctcgtcactgctgctgtgggactacctgtcccggcattcgtatgacgatctggtgcgcctggccgccgactgcgaccggctggccggctacgcccacgaccggttgctgaccttgcaggacaaactcggcatggatctgtgggtcgcccgcagcccgcagtccctcacggtgcgcttccgtcagccatgtgcagacatcgtccgcaagtactcgctgtcgtgtgagacggtctacgaagacaacgagcaacggacctacgtacatctctacgccgttccccacctcactcgggaactcgtggatgagctcgtgcgcgatctgcgccagcccggagccttcaccaacgctggtgcactggagggggaggcctgggccggggtgatcgatgccctcggccgcccggaccccgacggaacctatgccggcgccttgagcgctccggcttccggcccccgctccgaggacggcggcgggagctga

SEQ ID NO: 83 - protein, 440 aa, Alcaligenes denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 84 - DNA, 1947 bp, Alcaligenes denitrificans
ttcgatggcgcgctgcacggcggccaccagctgctccaccaggggtgggcgcctgcccgcgcgcgcggtcgggctggaaatcgatcatggatgaatctatacagttgtcatgattgcaactatacagttagcccgttttgcggcaattgtatattttcattcgctcgtggacgtccgagaatcggtttgatcgcgccgcccgcccctttccgcgcagcggcgtttcttttcctccggagtctccccatgagcgctgccaaactgcccgacctgtcccacctctggatgccctttaccgccaaccggcagttcaaggcgaacccccgcctgctggcctcggccaagggcatgtactacacgtctttcgacggccgccagatcctggacggcacggccggcctgtggtgcgtgaacgccggccactgccgcgaagaaatcgtctccgccatcgccagccaggccggcgtcatggactacgcgccggggttccagctcggccacccgctggccttcgaggccgccaccgccgtggccggcctgatgccgcagggcctggaccgcgtgttcttcaccaattcgggctccgaatcggtggacaccgcgctgaagatcgccctggcctaccaccgcgcgcgcggcgaggcgcagcgcacccgcctcatcgggcgcgagcgcggctaccacggcgtgggcttcggcggcatttccgtgggcggcatctcgcccaaccgcaagaccttctccggcgcgctgctgccggccgtggaccacctgccgcacacccacagcctggaacacaacgccttcacgcgcggccagcccgagtggggcgcgcacctggccgacgagttggaacgcatcatcgccctgcacgacgcctccaccatcgcggccgtgatcgtcgagcccatggccggctccaccggcgtgctcgtcccgcccaagggctatctcgaaaaactgcgcgaaatcaccgcccgccacggcattctgctgatcttcgacgaagtcatcaccgcgtacggccgcctgggcgaggccaccgccgcggcctatttcggcgtaacgcccgacctcatcaccatggccaagggcgtgagcaacgccgccgttccggccggcgccgtcgcggtgcgccgcgaagtgcatgacgccatcgtcaacggaccgcaaggcggcatcgagttcttccacggctacacctactcggcccacccgctggccgccgccgccgtgctcgccacgctggacatctaccgccgcgaagacctgttcgcccgcgcccgcaagctgtcggccgcgttcgaggaagccgcccacagcctcaagggcgcgccgcacgtcatcgacgtgcgcaacatcggcctggtggccggcatcgagctgtcgccgcgcgaaggcgccccgggcgcgcgcgccgccgaagccttccagaaatgcttcgacaccggcctcatggtgcgctacacgggcgacatcctcgcggtgtcgcctccgctcatcgtcgacgaaaaccagatcggccagatcttcgagggcatcggcaaggtgctcaaggaagtggcttagggtgaacacgccctgagccggccccggcaggaaacgcgccgccgcgcggcggcgcgtccatcgaactcccgcatcgagcttttgcattcatgaagaaaatcacgcatttcatcaacggccagccccacgaaggccgcagcaaccgctacaccgagggcttcaacccggccacgggcgagtcgtctcctcgatctgcctgggcggggccgaagaagtggacctggccgtggcggccgcccgcgcggcctttcccgcctggtccgaaacgccggcgctcaagcgcgcgcgcgtgctgttcaacttcaaggcgctgctggacaagcaccaggacgagctggccgcgctcatcacgcgcgagcacggcaaggtgttttccga

SEQ ID NO: 85 - protein, 443 aa, Ralstonia eutropha
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 86 - DNA, 1341 bp, Ralstonia eutropha
atggccgactcacccaacaacctcgctcacgaacatccttcacttgaacactattggatgccttttaccgccaatcgccaattcaaagcgagccctcgtttactcgcccaagctgaaggtatgtattacacagatatcaatggcaacaaggtattagactctacagcgggcttatggtgttgtaatgctggccatggtcgccgtgagatcagtgaagccgtcagcaaacaaattcggcagatggattacgctccctccttccaaatgggccatcccatcgcttttgaactggccgaacgtttaaccgaactcagcccagaaggactcaacaaagtattctttaccaactcaggctctgagtcggttgataccgcgctaaaaatggctctttgctaccatagagccaatggccaagcgtcacgcacccgctttattggccgtgaaatgggttaccatggcgtaggatttggtgggatctcggtgggtggtttaagcaataaccgtaaagccttcagcggccagctattgcaaggcgtggatcacctgccccacaccttagacattcaacatgccgcctttagtcgtggcttaccgagcctcggtgctgaaaaagctgaggtattagaacaattagtcacactccatggcgccgaaaatattgccgccgttattgttgaacccatgtcaggttctgcaggggtaattttaccacctcaaggctacttaaaacgcttacgtgaaatcactaaaaaacacggcatcttattgattttcgatgaagtcattaccgcatttggccgtgtaggtgcagcattcgccagccaacgttggggcgttattccagacataatcaccacggctaaagccattaataatggcgccatccccatgggcgcagtgtttgtacaggattatatccacgatacttgcatgcaagggccaaccgaactgattgaatttttccacggttatacctattcgggccacccagtcgccgcagcagcagcactcgccacgctctccatctaccaaaacgagcaactgtttgagcgcagttttgagcttgagcggtatttcgaagaagccgttcatagcctcaaagggttaccgaatgtgattgatattcgcaacaccggattagtcgcgggtttccagctagcaccgaatagccaaggtgttggtaaacgcggatacagcgtgttcgagcattgtttccatcaaggcacactcgtgcgggcaacgggcgatattatcgccatgtccccaccactcattgttgagaaacatcagattgaccaaatggtaaatagccttagcgatgcaattcacgccgttggatga

SEQ ID NO: 87 - protein, 446 aa, Shewanella oneidensis
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 88 - DNA, 1341 bp, Shewanella oneidensis; identical to SEQ ID NO: 86

SEQ ID NO: 89 - protein, 448 aa, Pseudomonas putida
MNMPETGPAGIASQLKLDAHWMPYTANRNFQRDPRLIVAAEGNYLVDDHGRKIFDALSGLWTCGAGHTRKEIADAVTRQLSTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGLPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMNQPTPEYAVEFPHGYTYSAHPVACAAGLAALDLLQKENLVQSAAELAPHFEKLLHGVKGTKNIVDIRNYGLAGAIQIAARDGDAIVRPYEAAMKLWKAGFYVRFGGDTLQFGPTFNTKPQELDRLFDAVGETLNLID

SEQ ID NO: 90 - protein, 930 aa, P. putida
ATGACCACGAAGAAAGCTGATTACATTTGGTTCAATGGGGAGATGGTTCGCTGGGAAGACGCGAAGGTGCATGTGATGTCGCACGCGCTGCACTATGGCACTTCGGTTTTTGAAGGCATCCGTTGCTACGACTCGCACAAAGGACCGGTTGTATTCCGCCATCGTGAGCATATGCAGCGTCTGCATGACTCCGCCAAAATCTATCGCTTCCCGGTTTCGCAGAGCATTGATGAGCTGATGGAAGCTTGTCGTGACGTGATCCGCAAAAACAATCTCACCAGCGCCTATATCCGTCCGCTGATCTTCGTCGGTGATGTTGGCATGGGAGTAAACCCGCCAGCGGGATACTCAACCGACGTGATTATCGCTGCTTTCCCGTGGGGAGCGTATCTGGGCGCAGAAGCGCTGGAGCAGGGGATCGATGCGATGGTTTCCTCCTGGAACCGCGCAGCACCAAACACCATCCCGACGGCGGCAAAAGCCGGTGGTAACTACCTCTCTTCCCTGCTGGTGGGTAGCGAAGCGCGCCGCCACGGTTATCAGGAAGGTATCGCGCTGGATGTGAACGGTTATATCTCTGAAGGCGCAGGCGAAAACCTGTTTGAAGTGAAAGATGGTGTGCTGTTCACCCCACCGTTCACCTCCTCCGCGCTGCCGGGTATTACCCGTGATGCCATCATCAAACTGGCGAAAGAGCTGGGAATTGAAGTACGTGAGCAGGTGCTGTCGCGCGAATCCCTGTACCTGGCGGATGAAGTGTTTATGTCCGGTACGGCGGCAGAAATCACGCCAGTGCGCAGCGTAGACGGTATTCAGGTTGGCGAAGGCCGTTGTGGCCCGGTTACCAAACGCATTCAGCAAGCCTTCTTCGGCCTCTTCACTGGCGAAACCGAAGATAAATGGGGCTGGTTAGATCAAGTTAATCAATAA

SEQ ID NO: 91 - protein, 394 aa, Escherichia coli
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 92 - protein, 1185 aa, Escherichia coli
ATGAAAAATTGTGTCATCGTCAGTGCGGTACGTACTGCTATCGGTAGTTTTAACGGTTCACTCGCTTCCACCAGCGCCATCGACCTGGGGGCGACAGTAATTAAAGCCGCCATTGAACGTGCAAAAATCGATTCACAACACGTTGATGAAGTGATTATGGGTAACGTGTTACAAGCCGGGCTGGGGCAAAATCCGGCGCGTCAGGCACTGTTAAAAAGCGGGCTGGCAGAAACGGTGTGCGGATTCACGGTCAATAAAGTATGTGGTTCGGGTCTTAAAAGTGTGGCGCTTGCCGCCCAGGCCATTCAGGCAGGTCAGGCGCAGAGCATTGTGGCGGGGGGTATGGAAAATATGAGTTTAGCCCCCTACTTACTCGATGCAAAAGCACGCTCTGGTTATCGTCTTGGAGACGGACAGGTTTATGACGTAATCCTGCGCGATGGCCTGATGTGCGCCACCCATGGTTATCATATGGGGATTACCGCCGAAAACGTGGCTAAAGAGTACGGAATTACCCGTGAAATGCAGGATGAACTGGCGCTACATTCACAGCGTAAAGCGGCAGCCGCAATTGAGTCCGGTGCTTTTACAGCCGAAATCGTCCCGGTAAATGTTGTCACTCGAAAGAAAACCTTCGTCTTCAGTCAAGACGAATTCCCGAAAGCGAATTCAACGGCTGAAGCGTTAGGTGCATTGCGCCCGGCCTTCGATAAAGCAGGAACAGTCACCGCTGGGAACGCGTCTGGTATTAACGACGGTGCTGCCGCTCTGGTGATTATGGAAGAATCTGCGGCGCTGGCAGCAGGCCTTACCCCCCTGGCTCGCATTAAAAGTTATGCCAGCGGTGGCGTGCCCCCCGCATTGATGGGTATGGGGCCAGTACCTGCCACGCAAAAAGCGTTACAACTGGCGGGGCTGCAACTGGCGGATATTGATCTCATTGAGGCTAATGAAGCATTTGCTGCACAGTTCCTTGCCGTTGGGAAAAACCTGGGCTTTGATTCTGAGAAAGTGAATGTCAACGGCGGGGCCATCGCGCTCGGGCATCCTATCGGTGCCAGTGGTGCTCGTATTCTGGTCACACTATTACATGCCATGCAGGCACGCGATAAAACGCTGGGGCTGGCAACACTGTGCATTGGCGGCGGTCAGGGAATTGCGATGGTGATTGAACGGTTGAATTAA

SEQ ID NO: 93 - protein, 392 aa, Clostridium acetobutylicum
MKEVVIASAVRTAIGSYGKSLKDVPAVDLGATAIKEAVKKAGIKPEDVNEVILGNVLQAGLGQNPARQASFKAGLPVEIPAMTINKVCGSGLRTVSLAAQIIKAGDADVIIAGGMENMSRAPYLANNARWGYRMGNAKFVDEMITDGLWDAFNDYHMGITAENIAERWNISREEQDEFALASQKKAEEAIKSGQFKDEIVPVVIKGRKGETVVDTDEHPRFGSTIEGLAKLKPAFKKDGTVTAGNASGLNDCAAVLVIMSAEKAKELGVKPLAKIVSYGSAGVDPAIMGYGPFYATKAAIEKAGWTVDELDLIESNEAFAAQSLAVAKDLKFDMNKVNVNGGAIALGHPIGASGARILVTLVHAMQKRDAKKGLATLCIGGGQGTAILLEKC

SEQ ID NO: 94 - protein, 1179 aa, Clostridium acetobutylicum
ATGAAAGAAGTTGTAATAGCTAGTGCAGTAAGAACAGCGATTGGATCTTATGGAAAGTCTCTTAAGGATGTACCAGCAGTAGATTTAGGAGCTACAGCTATAAAGGAAGCAGTTAAAAAAGCAGGAATAAAACCAGAGGATGTTAATGAAGTCATTTTAGGAAATGTTCTTCAAGCAGGTTTAGGACAGAATCCAGCAAGACAGGCATCTTTTAAAGCAGGATTACCAGTTGAAATTCCAGCTATGACTATTAATAAGGTTTGTGGTTCAGGACTTAGAACAGTTAGCTTAGCAGCACAAATTATAAAAGCAGGAGATGCTGACGTAATAATAGCAGGTGGTATGGAAAATATGTCTAGAGCTCCTTACTTAGCGAATAACGCTAGATGGGGATATAGAATGGGAAACGCTAAATTTGTTGATGAAATGATCACTGACGGATTGTGGGATGCATTTAATGATTACCACATGGGAATAACAGCAGAAAACATAGCTGAGAGATGGAACATTTCAAGAGAAGAACAAGATGAGTTTGCTCTTGCATCACAAAAAAAAGCTGAAGAAGCTATAAAATCAGGTCAATTTAAAGATGAAATAGTTCCTGTAGTAATTAAAGGCAGAAAGGGAGAAACTGTAGTTGATACAGATGAGCACCCTAGATTTGGATCAACTATAGAAGGACTTGCAAAATTAAAACCTGCCTTCAAAAAAGATGGAACAGTTACAGCTGGTAATGCATCAGGATTAAATGACTGTGCAGCAGTACTTGTAATCATGAGTGCAGAAAAAGCTAAAGAGCTTGGAGTAAAACCACTTGCTAAGATAGTTTCTTATGGTTCAGCAGGAGTTGACCCAGCAATAATGGGATATGGACCTTTCTATGCAACAAAAGCAGCTATTGAAAAAGCAGGTTGGACAGTTGATGAATTAGATTTAATAGAATCAAATGAAGCTTTTGCAGCTCAAAGTTTAGCAGTAGCAAAAGATTTAAAATTTGATATGAATAAAGTAAATGTAAATGGAGGAGCTATTGCCCTTGGTCATCCAATTGGAGCATCAGGTGCAAGAATACTCGTTACTCTTGTACACGCAATGCAAAAAAGAGATGCAAAAAAAGGCTTAGCAACTTTATGTATAGGTGGCGGACAAGGAACAGCAATATTGCTAGAAAAGTGCTAG

SEQ ID NO: 95 - protein, 392 aa, Clostridium acetobutylicum
MRDVVIVSAVRTAIGAYGKTLKDVPATELGAIVIKEAVRRANINPNEINEVIFGNVLQAGLGQNPARQAAVKAGLPLETPAFTINKVCGSGLRSISLAAQIIKAGDADTIVVGGMENMSRSPYLINNQRWGQRMGDSELVDEMIKDGLWDAFNGYHMGVTAENIAEQWNITREEQDEFSLMSQQKAEKAIKNGEFKDEIVPVLIKTKKGEIVFDQDEFPRFGNTIEALRKLKPIFKENGTVTAGNASGLNDGAAALVIMSADKANALGIKPLAKITSYGSYGVDPSIMGYGAFYATKAALDKINLKPEDLDLIEANEAYASQSIAVTRDLNLDMSKVNVNGGAIALGHPIGASGARILVTLLYAMQKRDSKKGLATLCIGGGQGTALVVERD

SEQ ID NO: 96 - DNA, 1179 bp, Clostridium acetobutylicum
atgagagatgtagtaatagtaagtgctgtaagaactgcaataggagcatatggaaaaacattaaaggatgtacctgcaacagagttaggagctatagtaataaaggaagctgtaagaagagctaatataaatccaaatgagattaatgaagttatttttggaaatgtacttcaagctggattaggccaaaacccagcaagacaagcagcagtaaaagcaggattacctttagaaacacctgcgtttacaatcaataaggtttgtggttcaggtttaagatctataagtttagcagctcaaattataaaagctggagatgctgataccattgtagtaggtggtatggaaaatatgtctagatcaccatatttgattaacaatcagagatggggtcaaagaatgggagatagtgaattagttgatgaaatgataaaggatggtttgtgggatgcatttaatggatatcatatgggagtaactgcagaaaatattgcagaacaatggaatataacaagagaagagcaagatgaattttcacttatgtcacaacaaaaagctgaaaaagccattaaaaatggagaatttaaggatgaaatagttcctgtattaataaagactaaaaaaggtgaaatagtctttgatcaagatgaatttcctagattcggaaacactattgaagcattaagaaaacttaaacctattttcaaggaaaatggtactgttacagcaggtaatgcatccggattaaatgatggagctgcagcactagtaataatgagcgctgataaagctaacgctctcggaataaaaccacttgctaagattacttcttacggatcatatggggtagatccatcaataatgggatatggagctttttatgcaactaaagctgccttagataaaattaatttaaaacctgaagacttagatttaattgaagctaacgaggcatatgcttctcaaagtatagcagtaactagagatttaaatttagatatgagtaaagttaatgttaatggtggagctatagcacttggacatccaataggtgcatctggtgcacgtattttagtaacattactatacgctatgcaaaaaagagattcaaaaaaaggtcttgctactctatgtattggtggaggtcagggaacagctctcgtagttgaaagagactaa

SEQ ID NO: 97 - protein, 393 aa, Bacillus subtilis
MRKTVIVSAARTPFGKFGGVLKEVKAAELGGIVMKEALQQAGVSGDDVEGNVMGMVVQAGSGQIPSRQAARLAGMPWSVPSETLNKVCASGLRAVTLCDQMIRAQDADILVAGGMESMSNIPYAVPAGRWGARMGDGELRDLMVYDGLTCAFDEVHMAVHGNTAAKEYAISRREQDEWALRSHARAAKAADEGKFQDEIVPVNWIGRKGKPNVVDKDEAIRRDTSLDQLAKLAPIYASDGSITAGNAPGVNDGAGAFVLMSEEKAAELGKRPLATILGFSTTGMPAHELAAAPGFAINKLLKKNGLTVQDIDLFEVNEAFASVVLTCEKIVGFDLEKVNVNGGAIALGHPIGASGARILMTLVYELKRRGGGLGVAAICSGAAQGDAVLVQVH

SEQ ID NO: 98 - protein, 1182 aa, Bacillus subtilis
TTAATGAACCTGCACTAAGACGGCGTCTCCCTGTGCTGCCCCGCTGCAAATAGCGGCAACGCCCAGACCCCCTCCCCGTCGCTTTAATTCATAAACAAGCGTCATGAGAATTCTCGCACCGCTCGCGCCGATCGGGTGGCCGAGCGCGATCGCACCGCCATTCACATTTACTTTTTCAAGATCGAAACCTACGATTTTTTCACATGTCAAAACAACTGAAGCAAAAGCTTCATTTACTTCAAACAAGTCAATATCTTGGACAGTTAAACCATTCTTTTTCAGGAGCTTGTTAATAGCAAACCCTGGCGCTGCCGCCAGCTCGTGCGCTGGCATTCCCGTAGTTGAAAAACCAAGAATTGTAGCCAGAGGCCGTTTGCCAAGCTCAGCAGCTTTTTCCTCAGACATCAGCACGAACGCGCCGGCTCCGTCATTGACTCCAGGAGCATTGCCGGCTGTGATAGAACCGTCACTTGCATAAATCGGAGCAAGTTTTGCGAGCTGATCCAGACTTGTGTCACGGCGAATCGCTTCATCTTTATCAACAACGTTTGGTTTTCCTTTTCGACCGATCCAGTTGACGGGAACAATTTCATCCTGAAACTTCCCTTCATCGGCGGCCTTAGCTGCCCTTGCATGACTTCTCAACGCCCATTCGTCCTGCTCTCTTCGTGAGATTGCATATTCCTTGGCAGCTGTATTTCCGTGAACAGCCATGTGCACCTCGTCAAATGCGCACGTTAATCCGTCATACACCATTAAGTCCCTAAGCTCGCCGTCCCCCATCCGTGCTCCCCAGCGCCCGGCGGGAACGGCATACGGAATATTGCTCATGCTTTCCATCCCCCCCGCAACAAGTATGTCCGCATCCTGCGCCCGAATCATTTGATCACATAAAGTGACAGCGCGAAGGCCGGAAGCACAGACTTTATTCAGTGTTTCTGACGGCACACTCCAAGGCATTCCCGCCAGACGGGCAGCTTGACGGGAAGGTATCTGCCCTGAGCCGGCCTGGACAACCATGCCCATGACGTTTCCTTCTACATCATCTCCAGAGACTCCAGCCTGTTGCAGCGCCTCCTTCATCACAATGCCCCCAAGCTCAGCAGCTTTCACCTCTTTCAAAACTCCGCCGAATTTGCCAAATGGAGTTCTTGCAGCACTTACAATGACTGTTTTCCTCAT

SEQ ID NO: 99 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 100 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 101 - protein, 282 aa, Clostridium acetobutylicum
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSK

SEQ ID NO: 102 - protein, 849 aa, Clostridium acetobutylicum
ATGAAAAAGGTATGTGTTATAGGTGCAGGTACTATGGGTTCAGGAATTGCTCAGGCATTTGCAGCTAAAGGATTTGAAGTAGTATTAAGAGATATTAAAGATGAATTTGTTGATAGAGGATTAGATTTTATCAATAAAAATCTTTCTAAATTAGTTAAAAAAGGAAAGATAGAAGAAGCTACTAAAGTTGAAATCTTAACTAGAATTTCCGGAACAGTTGACCTTAATATGGCAGCTGATTGCGATTTAGTTATAGAAGCAGCTGTTGAAAGAATGGATATTAAAAAGCAGATTTTTGCTGACTTAGACAATATATGCAAGCCAGAAACAATTCTTGCATCAAATACATCATCACTTTCAATAACAGAAGTGGCATCAGCAACTAAAAGACCTGATAAGGTTATAGGTATGCATTTCTTTAATCCAGCTCCTGTTATGAAGCTTGTAGAGGTAATAAGAGGAATAGCTACATCACAAGAAACTTTTGATGCAGTTAAAGAGACATCTATAGCAATAGGAAAAGATCCTGTAGAAGTAGCAGAAGCACCAGGATTTGTTGTAAATAGAATATTAATACCAATGATTAATGAAGCAGTTGGTATATTAGCAGAAGGAATAGCTTCAGTAGAAGACATAGATAAAGCTATGAAACTTGGAGCTAATCACCCAATGGGACCATTAGAATTAGGTGATTTTATAGGTCTTGATATATGTCTTGCTATAATGGATGTTTTATACTCAGAAACTGGAGATTCTAAGTATAGACCACATACATTACTTAAGAAGTATGTAAGAGCAGGATGGCTTGGAAGAAAATCAGGAAAAGGTTTCTACGATTATTCAAAATAA

SEQ ID NO: 103 - protein, 287 aa, Bacillus subtilis
MEIKQIMVAGAGQMGSGIAQTAADAGFYVRMYDVNPEAAEAGLKRLKKQLARDAEKGKRTETEVKSVINRISISQTLEEAEHADIVIEAIAENMAAKTEMFKTLDRICPPHTILASNTSSLPITEIAAVTNRPQRVIGMHFMNPVPVMKLVEVIRGLATSEETALDVMALAEKMGKTAVEVNDFPGFVSNRVLLPMINEAIYCVYEGVAKPEAIDEVMKLGMNHPMGPLALADFIGLDTCLSIMEVLHSGLGDSKYRPCPLLRKYVKAGWLGKKSGRGFYDYEEKTS

SEQ ID NO: 104 - DNA, 5211 bp, Bacillus subtilis
actgaagaaaatgaggaacggtttgattaaggtaaggccgtatacagtcaatcgtccggaagatatgaagcgtctcattgaagcgggagcagacggcatgtttaccgactttccagaaaaggcttcggcattgctgaaaaatgaatagttgttagaaggaggctgtttgacgcgaccttcttttttcattcattcatgcccgtttcaaagcatacattcatagaagacaactagaaattgtaagcgctgtctatcttctgaatgaggtgaaaccatgaggaaaacagtcattgtaagtgctgcaagaactccatttggcaaattcggcggagttttgaaagaggtgaaagctgctgagcttgggggcattgtgatgaaggaggcgctgcaacaggctggagtctctggagatgatgtagaaggaaacgtcatgggcatggttgtccaggccggctcagggcagataccttcccgtcttgctgcccgtctggcgggaatgccttggagtgtgccgtcagaaacactgaataaagtctgtgcttccggccttcgcgctgtcactttatgtgatcaaatgattcgggcgcaggatgcggacatacttgttgcgggggggatggaaagcatgagcaatattccgtatgccgttcccgccgggcgctggggagcacggatgggggacggcgagcttagggacttaatggtgtatgacggattaacgtgcgcatttgacgaggtgcacatggctgttcacggaaatacagctgccaaggaatatgcaatctcacgaagagagcaggacgaatgggcgttgagaagtcatgcaagggcagctaaggccgccgatgaagggaagtttcaggatgaaattgttcccgtcaactggatcggtcgaaaaggaaaaccaaacgttgttgataaagatgaagcgattcgccgtgacacaagtctggatcagctcgcaaaacttgctccgatttatgcaagtgacggttctatcacagccggcaatgctcctggagtcaatgacggagccggcgcgttcgtgctgatgtctgaggaaaaagctgctgagcttggcaaacggcctctggctacaattcttggtttttcaactacgggaatgccagcgcacgagctggcggcagcgccagggtttgctattaacaagctcctgaaaaagaatggtttaactgtccaagatattgacttgtttgaagtaaatgaagcttttgcttcagttgttttgacatgtgaaaaaatcgtaggtttcgatcttgaaaaagtaaatgtgaatggcggtgcgatcgcgctcggccacccgatcggcgcgagcggtgcgagaattctcatgacgcttgtttatgaattaaagcgacggggagggggtctgggcgttgccgctatttgcagcggggcagcacagggagacgccgtcttagtgcaggttcattaaaacatgatgaaaaaggggatttgaatggaaatcaaacaaatcatggtagctggcgcaggtcagatggggagcggaattgctcaaacagccgccgacgcgggcttttatgtgcggatgtatgatgtgaatccagaggccgcggaggcaggattgaaacggctgaagaaacagctggcccgtgatgctgagaaaggaaaaaggaccgagacggaagtgaagagcgtaatcaaccgcatttcgatttctcaaacacttgaggaggcagagcatgcggacattgtgattgaggctatcgcagaaaacatggcggcaaaaactgagatgtttaaaacacttgatcgcatttgcccgcctcatacgattttggccagcaatacatcttccttgcctattacagaaatcgctgctgtaacaaaccggcctcaacgggttattggcatgcattttatgaatcccgtccctgtaatgaagctggtagaagtgattcgaggcttggctacatcagaagaaacggccttagatgttatggcattagcggaaaagatggggaaaacagcggtagaagtcaatgattttcctgggtttgtttccaaccgtgtgcttcttccaatgattaatgaagccatctattgcgtgtatgagggagtggcgaagccggaggcaatagatgaagtgatgaagctgggcatgaatcatccgatgggtccgcttgcattagcggattttatcggactggatacgtgtttatcaattatggaagtccttcactcaggccttggcgattccaaataccgtccttgcccgctgctccgcaagtatgtcaaagcaggctggcttggcaaaaagagcggacgcggtttttatgactatgaggagaagacttcctgaagtctattccatccgggggtggccgagttgcatgtaacccaagagcaagtcatgatgcgaaaaatggtgcgtgattttgcacgaaaagaaattgctcccgctgcggaaatcatggagaaaacggacgaatttccctttcagctgatcaaaaaaatgggtaaacacggactgatgggaataccggtgccggaacaatacggcggtgctggagcggacgttgtttcttatattttggcaattcatgagatttctagaatcagcgcggctgtcggcgtgattctctccgttcatacctcagtcggcacgaatccgattatgtatttcggcaacgaagaacagaagatgaaatatataccaaatctcgcgtcaggagaccatttgggcgcatttgcactaacggagcctcactcggggtcggatgccgggagcctccgcacaacagcaatcaaaaagaacggcaaatacctattaaacggatcgaaaatattcataacgaatggcggagcagctgatatctatatcacatttgctttaacagatccagatcaaggcaggcacgggatttcggcttttattgttgaaaaaaacacacccggttttaccgttggaaaaaaagaaagaaagctggggctttatggctccaatactacggaactgatttttgataatgcagaagtgcctgaagccaatttgcttggcaaagagggggatggctttcacattgccatggcgaatttaaatgtcggccggatcggcattgcggcacaggccctcggaattgcagaggcggctcttgagcatgccgttgattatgcgaagcagcgagtgcaatttggaaggccgattgcagccaatcaaggcatatcatttaagctggctgatatggcgactagagctgaggcggcaagacatcttgtctaccacgctgcagaccttcataaccgcggcctaaactgtggaaaagaagcgtctatggctaaacaatttgcttccgatgcagccgtaaaggcggcgttagacgccgttcaaatttatgggggatatggctatatgaaggattatccagttgagcgcctgcttcgcgatgcaaaggtgacgcaaatttatgaagggacgaacgagattcaaagactgattatttccaagtatttgcttggcggaacctgatagacaaaaaacgcaaaaacggaggttgaggatatggaggagaaacagcattattctccagggttggacggtgtgattgcggcagaaactcatatttcttatcttgacacgcagtccagccagattttgataagaggctatgatttaatagaactttctgaaacaaaaagctatctggagcttgtccatttattgctggagggcaggctgccagaagaaagtgaaatggaaacgctggaacgtaaaataaacagtgcctcaagcctgcctgctgatcatctccgtctgcttgagctgctccctgaggacactcatccaatggatggtctgcgtaccggcctgtcggcacttgctggctatgatcggcaaattgatgatcggtctccttccgcaaacaaagaacgcgcctatcagcttcttgggaaaatgcctgccctcactgctgccagctacaggatcattaataagaaagaaccgattcttccgcttcaaaccctatcctacagtgcgaattttctctacatgatgacagggaaattgccgtcttcattggaagaacagatttttgaccggtcgctcgtcctgtacagtgagcatgagatgccgaattcaacctttgcggccagggtcattgcatctacacattcagatctttatggggctttgactggggctgtcgcttccctgaaagggaatcttcacggaggagcaaacgaagctgtgatgtatttgcttttggaggcaaaaacgacatctgattttgagcagcttttgcaaacaaaactgaaaagaaaagaaaaaatcatgggcttcggccaccgggtgtatatgaaaaaaatggacccgagagcactcatgatgaaagaggcgctgcagcaattatgcgataaagccggtgaccatcgtttatatgagatgtgcgaagcgggtgagcggctgatggagaaggaaaaagggctttacccgaatttggattactatgctgccccagtgtattggatgctcggcataccgattcctttatatacgccgatctttttcagcgcgagaacgtccggtttatgcgcccatgtgatcgaacagcatgccaataatcggctcttccgtccccgtgtcagttacatgggcccgcgatatcaaacaaaatcatgaaaggagctggtagaatgccgaaaacggatcgtgttatcgaagaaatcacagactatgtgcttgagaaagagattactagtgccgaagcgtatacaacagcggggcatgtattgctggataccctgggctgcggaatcttggcgctacggtatccggaatgcacaaagctgcttggcccgattgttccaggaacgactgtgccgaatggaagcaaagtgccgggaacgtcatatgttctcgatcctgtgagggcagcgtttaatattggctgcatgattcgctggctcgattacaacgatacgtggctggcggcggagtgggggcatccatccgataacttgggaggaatccttgccgctgctgattatgtatcaagagtgaggctgtctgaaggaaaagagccgttaacggtacgcgacgtacttgagatgatgatcaaagcacacgagatccaaggtgtgctggcgttagaaaacagcttaaatcgagttggccttgaccatgtgctgtttgtcaaagttgcgacaactgctgttgcagcaaagctt

SEQ ID NO: 105 - protein, 284 aa, Ralstonia eutropha
MAIRTVGIVGAGTMGNGIAQACAVVGLDVVMVDISDAAVQKGIATVAGSLDRLIKKDKISEADKMTALARIHGSTAYDDLKKADIVIEAATENFDLKVKILKQIDSIVGENVIIASNTSSISITKLAAVTSRPERFIGMHFFNPVPVMALVELIRGLQTSDAAHADVEALAKELGKYPITVKNSPGFVVNRILCPMINEAFCVLGEGLASPEEIDEGMKLGCNHPIGPLALADMIGLDTMLAVMEVLYTEFADPKYRPAMLMREMVAAGYLGRKTGRGVYVYSK

SEQ ID NO: 106 - DNA, 741 bp, Ralstonia eutropha
atgactcagcgcattgcgtatgtgaccggcggcatgggtggtatcggaaccgccatttgccagcggctggccaaggatggctttcgtgtggtggccggttgcggccccaactcgccgcgccgcgaaaagtggctggagcagcagaaggccctgggcttcgatttcattgcctcggaaggcaatgtggctgactgggactcgaccaagaccgcattcgacaaggtcaagtccgaggtcggcgaggttgatgtgctgatcaacaacgccggtatcacccgcgacgtggtgttccgcaagatgacccgcgccgactgggatgcggtgatcgacaccaacctgacctcgctgttcaacgtcaccaagcaggtgatcgacggcatggccgaccgtggctggggccgcatcgtcaacatctcgtcggtgaacgggcagaagggccagttcggccagaccaactactccaccgccaaggccggcctgcatggcttcaccatggcactggcgcaggaagtggcgaccaagggcgtgaccgtcaacacggtctctccgggctatatcgccaccgacatggtcaaggcgatccgccaggacgtgctcgacaagatcgtcgcgacgatcccggtcaagcgcctgggcctgccggaagagatcgcctcgatctgcgcctggttgtcgtcggaggagtccggtttctcgaccggcgccgacttctcgctcaacggcggcctgcatatgggctga

SEQ ID NO: 107 - protein, 246 aa, Alcaligenes eutrophus
MTQRIAYVTGGMGGIGTAICQRLAKDGFRVVAGCGPNSPRREKWLEQQKALGFDFIASEGNVADWDSTKTAFDKVKSEVGEVDVLINNAGITRDVVFRKMTRADWDAVIDTNLTSLFNVTKQVIDGMADRGWGRIVNISSVNGQKGQFGQTNYSTAKAGLHGFTMALAQEVATKGVTVNTVSPGYIATDMVKAIRQDVLDKIVATIPVKRLGLPEEIASICAWLSSEESGFSTGADFSLNGGLHMG

SEQ ID NO: 108 - DNA, 2328 bp, Alcaligenes eutrophus
ctgcaggttccctcccgtttccattgaaaggactacacaatgactgacgttgtcatcgtatccgccgcccgcaccgcggtcggcaagtttggcggctcgctggccaagatcccggcaccggaactgggtgccgtggtcatcaaggccgcgctggagcgcgccggcgtcaagccggagcaggtgagcgaagtcatcatgggccaggtgctgaccgccggttcgggccagaaccccgcacgccaggccgcgatcaaggccggcctgccggcgatggtgccggccatgaccatcaacaaggtgtgcggctcgggcctgaaggccgtgatgctggccgccaacgcgatcatggcgggcgacgccgagatcgtggtggccggcggccaggaaaacatgagcgccgccccgcacgtgctgccgggctcgcgcgatggtttccgcatgggcgatgccaagctggtcgacaccatgatcgtcgacggcctgtgggacgtgtacaaccagtaccacatgggcatcaccgccgagaacgtggccaaggaatacggcatcacacgcgaggcgcaggatgagttcgccgtcggctcgcagaacaaggccgaagccgcgcagaaggccggcaagtttgacgaagagatcgtcccggtgctgatcccgcagcgcaagggcgacccggtggccttcaagaccgacgagttcgtgcgccagggcgccacgctggacagcatgtccggcctcaagcccgccttcgacaaggccggcacggtgaccgcggccaacgcctcgggcctgaacgacggcgccgccgcggtggtggtgatgtcggcggccaaggccaaggaactgggcctgaccccgctggccacgatcaagagctatgccaacgccggtgtcgatcccaaggtgatgggcatgggcccggtgccggcctccaagcgcgccctgtcgcgcgccgagtggaccccgcaagacctggacctgatggagatcaacgaggcctttgccgcgcaggcgctggcggtgcaccagcagatgggctgggacacctccaaggtcaatgtgaacggcggcgccatcgccatcggccacccgatcggcgcgtcgggctgccgtatcctggtgacgctgctgcacgagatgaagcgccgtgacgcgaagaagggcctggcctcgctgtgcatcggcggcggcatgggcgtggcgctggcagtcgagcgcaaataaggaaggggttttccggggccgcgcgcggttggcgcggacccggcgacgataacgaagccaatcaaggagtggacatgactcagcgcattgcgtatgtgaccggcggcatgggtggtatcggaaccgccatttgccagcggctggccaaggatggctttcgtgtggtggccggttgcggccccaactcgccgcgccgcgaaaagtggctggagcagcagaaggccctgggcttcgatttcattgcctcggaaggcaatgtggctgactgggactcgaccaagaccgcattcgacaaggtcaagtccgaggtcggcgaggttgatgtgctgatcaacaacgccggtatcacccgcgacgtggtgttccgcaagatgacccgcgccgactgggatgcggtgatcgacaccaacctgacctcgctgttcaacgtcaccaagcaggtgatcgacggcatggccgaccgtggctggggccgcatcgtcaacatctcgtcggtgaacgggcagaagggccagttcggccagaccaactactccaccgccaaggccggcctgcatggcttcaccatggcactggcgcaggaagtggcgaccaagggcgtgaccgtcaacacggtctctccgggctatatcgccaccgacatggtcaaggcgatccgccaggacgtgctcgacaagatcgtcgcgacgatcccggtcaagcgcctgggcctgccggaagagatcgcctcgatctgcgcctggttgtcgtcggaggagtccggtttctcgaccggcgccgacttctcgctcaacggcggcctgcatatgggctgacctgccggcctggttcaaccagtcggcagccggcgctggcgcccgcgtattgcggtgcagccagcgcggcgcacaaggcggcgggcgtttcgtttcgccgcccgtttcgcgggccgtcaaggcccgcgaatcgtttctgcccgcgcggcattcctcgctttttgcgccaattcaccgggttttccttaagccccgtcgcttttcttagtgccttgttgggcatagaatcagggcagcggcgcagccagcaccatgttcgtgcagcgcggccctcgcgggggcgaggctgcag

SEQ ID NO: 109 - protein, 255 aa, Escherichia coli
MSELIVSRQQRVLLLTLNRPAARNALNNALLMQLVNELEAAATDTSISVCVITGNARFFAAGADLNEMAEKDLAATLNDTRPQLWARLQAFNKPLIAAVNGYALGAGCELALLCDVVVAGENARFGLPEITLGIMPGAGGTQRLIRSVGKSLASKMVLSGESITAQQAQQAGLVSDVFPSDLTLEYALQLASKMARHSPLALQAAKQALRQSQEVALQAGLAQERQLFTLLAATEDRHEGISAFLQKRTPDFKGR

SEQ ID NO: 110 - protein, 768 aa, Escherichia coli
ATGAGCGAACTGATCGTCAGCCGTCAGCAACGAGTATTGTTGCTGACCCTTAACCGTCCCGCCGCACGTAATGCGCTAAATAATGCCCTGCTGATGCAACTGGTAAATGAACTGGAAGCTGCGGCTACCGATACCAGCATTTCGGTCTGTGTGATTACCGGTAATGCACGCTTTTTTGCCGCTGGGGCCGATCTCAACGAAATGGCAGAAAAAGATCTCGCGGCCACCTTAAACGATACACGTCCGCAGCTATGGGCGCGATTGCAGGCCTTTAATAAACCACTTATCGCAGCCGTCAATGGTTACGCGCTTGGGGCGGGTTGCGAACTGGCATTGTTGTGCGATGTGGTGGTTGCCGGAGAGAACGCGCGTTTTGGGTTGCCGGAAATCACTCTCGGCATCATGCCTGGCGCAGGCGGAACGCAACGTTTAATCCGTAGTGTCGGTAAATCGTTAGCCAGCAAAATGGTGCTGAGCGGAGAAAGTATCACCGCTCAGCAAGCACAGCAGGCCGGGCTGGTTAGCGACGTCTTCCCCAGCGATTTAACCCTCGAATACGCCTTACAGCTGGCATCGAAAATGGCACGTCACTCGCCGCTGGCCTTACAAGCGGCAAAGCAAGCGCTGCGCCAGTCGCAGGAAGTGGCTTTGCAAGCCGGACTTGCCCAGGAGCGACAGTTATTCACCTTGCTGGCGGCAACAGAAGATCGTCATGAAGGCATCTCCGCTTTCTTACAAAAACGCACGCCCGACTTTAAAGGACGCTAA

SEQ ID NO: 111 - protein, 261 aa, Clostridium acetobutylicum
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 112 - protein, 786 aa, Clostridium acetobutylicum
ATGGAACTAAACAATGTCATCCTTGAAAAGGAAGGTAAAGTTGCTGTAGTTACCATTAACAGACCTAAAGCATTAAATGCGTTAAATAGTGATACACTAAAAGAAATGGATTATGTTATAGGTGAAATTGAAAATGATAGCGAAGTACTTGCAGTAATTTTAACTGGAGCAGGAGAAAAATCATTTGTAGCAGGAGCAGATATTTCTGAGATGAAGGAAATGAATACCATTGAAGGTAGAAAATTCGGGATACTTGGAAATAAAGTGTTTAGAAGATTAGAACTTCTTGAAAAGCCTGTAATAGCAGCTGTTAATGGTTTTGCTTTAGGAGGCGGATGCGAAATAGCTATGTCTTGTGATATAAGAATAGCTTCAAGCAACGCAAGATTTGGTCAACCAGAAGTAGGTCTCGGAATAACACCTGGTTTTGGTGGTACACAAAGACTTTCAAGATTAGTTGGAATGGGCATGGCAAAGCAGCTTATATTTACTGCACAAAATATAAAGGCAGATGAAGCATTAAGAATCGGACTTGTAAATAAGGTAGTAGAACCTAGTGAATTAATGAATACAGCAAAAGAAATTGCAAACAAAATTGTGAGCAATGCTCCAGTAGCTGTTAAGTTAAGCAAACAGGCTATTAATAGAGGAATGCAGTGTGATATTGATACTGCTTTAGCATTTGAATCAGAAGCATTTGGAGAATGCTTTTCAACAGAGGATCAAAAGGATGCAATGACAGCTTTCATAGAGAAAAGAAAAATTGAAGGCTTCAAAAATAGATAG

SEQ ID NO: 113 - protein, 260 aa, Bacillus subtilis
MGDSILFTVKNEHMALITLNRPQAANALSAEMLRNLQMIIQEIEFNSNIRCVILTGTGEKAFCAGADLKERIKLKEDQVLESVSLIQRTAALLDALPQPVIAAINGSALGGGLELALACDLRIATEAAVLGLPETGLAIIPGAGGTQRLPRLIGRGKAKEFIYTGRRVTAHEAKEIGLVEHVTAPCDLMPKAEELAAAISANGPIAVRQAKFAINKGLETDLATGLAIEQKAYEQTIPTKDRREGLQAFQEKRRAVYKGI

SEQ ID NO: 114 - DNA, 783 bp, Bacillus subtilis
atgggagattctattctttttactgttaaaaatgaacatatggcgttgatcaccttaaacaggcctcaggcagcaaatgctctttcagcggaaatgcttagaaacctgcaaatgattatccaggaaattgaatttaactcaaacatccgttgcgtcatcctcacaggcaccggtgaaaaagcgttttgtgcaggggcagacctgaaggaacggataaaactgaaagaagatcaggttctggaaagtgtatctctcattcaaagaacggcggctttacttgatgccttgccgcagccggtcatagctgcgataaatggaagcgcattaggcggcggactagaattggcattggcatgcgaccttcgaatcgcaactgaagcagctgtgctgggacttccggaaacagggttagctattatcccgggcgctggagggacccaaaggctgccccggctgattggcagaggaaaagcaaaagaattcatttatacaggcagacgcgtgaccgcacacgaagcaaaagaaatcggccttgtagagcatgtcacggctccttgtgaccttatgccaaaagcagaggaactggccgcagccatttctgccaacggaccgatcgctgtccgtcaggctaaatttgcaatcaataaaggattggagacagatcttgctacaggccttgcgattgaacaaaaagcgtatgaacaaaccatcccgacaaaagacaggagagaagggcttcaggcctttcaagaaaaaagacgggccgtatacaagggaatataa

SEQ ID NO: 115 - protein, 134 aa, Aeromonas caviae
MSAQSLEVGQKARLSKRFGAAEVAAFAALSEDFNPLHLDPAFAATTAFERPIVHGMLLASLFSGLLGQQLPGKGSIYLGQSLSFKLPVFVGDEVTAEVEVTALREDKPIATLTTRIFTQGGALAVTGEAVVKLP

SEQ ID NO: 116 - DNA, 5051 bp, Aeromonas caviae
gatatccatcagcccctgacagagagcactgatatgaccggcaggcatcgccatcccctgccatcccgccgcgtactgggtgtgattggaaaactgcaccgtattgacgggccagacctccatgccgagacggcgcatggggaagacggcggcgctgttgccggcacagccgaaaaccacgtgggactggatagagagaatgcgtttcatcgacaccaccactgaagaagcatgaggaaagcgggcaatatatcggatgcatagcgggctctgccagcgattcccggcaaccctcgccatttatgcggcaaaaagcccattcaatggagtgttacaccaacttccccccacgcctgctcaacctggcaagccaagagcgcctcggccccgtcggtgtgatatgggctcttcacactcttgtttgatggcatatgagggcatttttaatacaaggtggcggatggcgggagaaagcgtcgaggaagagcaatgaggcgcggcggcaggcaagccggggccgacgccccgggctttgtacttaaggcttaaggcctgacgaagtgatagacccagccttcgtccagggggaaatcggagggcgcagagacaagtgccggcagggaggcgacggcccctccggcggcgtattgcagcgccatcagggcgcagagggcggcgtcgtaacgatccgtcccggccaccacatcaggtggcaaggaggcggctatctccgccctggccggtgaggccttgcctgctaccttggcaaagagccgggatagacctccagcacggcgcgatcggcgtggggctgctgcctcgggcacaagctgcagatccccgaggcgcggcaagatggagagcgccagggtggcgttgttgcctagcctgtcgaaggtggccgacagcggcttcttgccgtattgctgctgcagccagcgctcgcagtcccgataggcataggggttgtctatctcccgctggggcacggcgcactcgactcccctccccgccagcagatcgccgagggctcggggaaaggccaggggggcatcgatgccgagcgccagtcgcgggcaggccagcacctgcatcagcgccatctcgtcttgcagcgccgggcgcagcaaggcgtccagatccggcgccacccgggagctcaaccgaaacaggggggagaccccgagccagtgcaactgctgcgtgcgggcctgccagcccaccacggccaccgcctgggcattgccctgccagccccttacatcccaaccgatgccgatggcatccaagtgttccgttgtcatgcccctgtcacctctgcgcactattgatggagcacagggtaatggctgcgcccctcaaagcaaggctggcggcaccgcttagaaagatttcttgaagttgatcagcggcaagatggggaagatgccgttctctgcgtagttggcgagccctatctgcaggccatcgaggtgcttggtggcattgatgaagccaagctggaaggtggtgcgctcggcatagttgacgaagccgaggttggccagggcattgcccttggcgatgttgaccgccccccagttcagcccctgcacgttgttggtcaggttgacgaaacccaggttgaccccggtgtcctgcccctcatgccagttgacggcgttgatggcgaccccgccgaactgatggcgcacccgggcggcgccgaagaagatgccaagctgcaggccggtgaactgatccacgtcggagagggcgaacaccggcagatctatgcccttcacctgaccggtgcggccatacaggaaggaggcgcgcgccccttccacctggtgggaggaaggcaggttgatgccgggcagggagatctggaccggggtgctggcctgggccacgccggcgagggccagcgcggagcaaccgagcagcagggcgagaggtttcatcgggattccttggcagtctgaatgacgtgccagcctatcagcgcggcgccggtgcggcgagggcgcgccggacccagtgcgtcacctctcgtctgatccgcctccctcgacgggcgtcgctgacaaaaaaattcaaacagaaattaacatttatgtcatttacaccaaaccgcatttggttgcagaatgctcaaacgtgtgtttgaacagagcaagcaacacgtaaacagggatgacatgcagtacccgtaagaagggccgattggcccacaacaacactgttctgccgaactggagaccgatgatgaatatggacgtgatcaagagctttaccgagcagatgcaaggcttcgccgcccccctcacccgctacaaccagctgctggccagcaacatcgaacagctgacccggttgcagctggcctccgccaacgcctacgccgaactgggcctcaaccagttgcaggccgtgagcaaggtgcaggacacccagagcctggcggccctgggcacagtgcaactggagaccgccagccagctctcccgccagatgctggatgacatccagaagctgagcgccctcggccagcagttcaaggaagagctggatgtcctgaccgcagacggcatcaagaaaagcacgggcaaggcctgataacccctggctgcccgttcgggcagccacatctccccatgactcgacgctacgggctagttcccgcctcgggtgtgggtgaaggagagcacatgagccaaccatcttatggcccgctgttcgaggccctggcccactacaatgacaagctgctggccatggccaaggcccagacagagcgcaccgcccaggcgctgctgcagaccaatctggacgatctgggccaggtgctggagcagggcagccagcaaccctggcagctgatccaggcccagatgaactggtggcaggatcagctcaagctgatgcagcacaccctgctcaaaagcgcaggccagccgagcgagccggtgatcaccccggagcgcagcgatcgccgcttcaaggccgaggcctggagcgaacaacccatctatgactacctcaagcagtcctacctgctcaccgccaggcacctgctggcctcggtggatgccctggagggcgtcccccagaagagccgggagcggctgcgtttcttcacccgccagtacgtcaacgccatggcccccagcaacttcctggccaccaaccccgagctgctcaagctgaccctggagtccgacggccagaacctggtgcgcggactggccctcttggccgaggatctggagcgcagcgccgatcagctcaacatccgcctgaccgacgaatccgccttcgagctcgggcgggatctggccctgaccccgggccgggtggtgcagcgcaccgagctctatgagctcattcagtacagcccgactaccgagacggtgggcaagacacctgtgctgatagtgccgcccttcatcaacaagtactacatcatggacatgcggccccagaactccctggtcgcctggctggtcgcccagggccagacggtattcatgatctcctggcgcaacccgggcgtggcccaggcccaaatcgatctcgacgactacgtggtggatggcgtcatcgccgccctggacggcgtggaggcggccaccggcgagcgggaggtgcacggcatcggctactgcatcggcggcaccgccctgtcgctcgccatgggctggctggcggcgcggcgccagaagcagcgggtgcgcaccgccaccctgttcactaccctgctggacttctcccagcccggggagcttggcatcttcatccacgagcccatcatagcggcgctcgaggcgcaaaatgaggccaagggcatcatggacgggcgccagctggcggtctccttcagcctgctgcgggagaacagcctctactggaactactacatcgacagctacctcaagggtcagagcccggtggccttcgatctgctgcactggaacagcgacagcaccaatgtggcgggcaagacccacaacagcctgctgcgccgtctctacctggagaaccagctggtgaagggggagctcaagatccgcaacacccgcatcgatctcggcaaggtgaagacccctgtgctgctggtgtcggcggtggacgatcacatcgccctctggcagggcacctggcagggcatgaagctgtttggcggggagcagcgcttcctcctggcggagtccggccacatcgccggcatcatcaacccgccggccgccaacaagtacggcttctggcacaacggggccgaggccgagagcccggagagctggctggcaggggcgacgcaccagggcggctcctggtggcccgagatgatgggctttatccagaaccgtgacgaagggtcagagcccgtccccgcgcgggtcccggaggaagggctggcccccgcccccggccactatgtcaaggtgcggctcaaccccgtgtttgcctgcccaacagaggaggacgccgcatgagcgcacaatccctggaagtaggccagaaggcccgtctcagcaagcggttcggggcggcggaggtagccgccttcgccgcgctctcggaggacttcaaccccctgcacctggacccggccttcgccgccaccacggcgttcgagcggcccatagtccacggcatgctgctcgccagcctcttctccgggctgctgggccagcagttgccgggcaaggggagcatctatctgggtcaaagcctcagcttcaagctgccggtctttgtcggggacgaggtgacggccgaggtggaggtgaccgcccttcgcgaggacaagcccatcgccaccctgaccacccgcatcttcacccaaggcggcgccctcgccgtgacgggggaagccgtggtcaagctgccttaagcaccggcggcacgcaggcacaatcagcccggcccctgccgggctgattgttctcccccgctccgcttgccccctttttcggggcaatttggcccaggccctttccctgccccgcctaactgcctaaaatggccgccctgccgtgtaggcattcatccagctagaggaattc

SEQ ID NO: 117 - protein, 398 aa, Clostridium acetobutylicum
MIVKAKFVKGFIRDVHPYGCRREVLNQIDYCKKAIGFRGPKKVLIVGASSGFGLATRISVAFGGPEAHTIGVSYETGATDRRIGTAGWYNNIFFKEFAKKKGLVAKNFIEDAFSNETKDKVIKYIKDEFGKIDLFVYSLAAPRRKDYKTGNVYTSRIKTILGDFEGPTIDVERDEITLKKVSSASIEEIEETRKVMGGEDWQEWCEELLYEDCFSDKATTIAYSYIGSPRTYKIYREGTIGIAKKDLEDKAKLINEKLNRVIGGRAFVSVNKALVTKASAYIPTFPLYAAILYKVMKEKNIHENCIMQIERMFSEKIYSNEKIQFDDKGRLRMDDLELRKDVQDEVDRIWSNITPENFKELSDYKGYKKEFMNLNGFDLDGVDYSKDLDIELLRKLEP

SEQ ID NO: 118 - protein, 398 aa, Clostridium acetobutylicum; identical to SEQ ID NO: 117

SEQ ID NO: 119 - protein, 539 aa, Euglena gracilis
MSCPASPSAAVVSAGALCLCVATVLLATGSNPTALSTASTRSPTSLVRGVDRGLMRPTTAAALTTMREVPQMAEGFSGEATSAWAAAGPQWAAPLVAAASSALALWWWAARRSVRRPLAALAELPTAVTHLAPPMAMFTTTAKVIQPKIRGFICTTTHPIGCEKRVQEEIAYARAHPPTSPGPKRVLVIGCSTGYGLSTRITAAFGYQAATLGVFLAGPPTKGRPAAAGWYNTVAFEKAALEAGLYARSLNGDAFDSTTKARTVEAIKRDLGTVDLVVYSIAAPKRTDPATGVLHKACLKPIGATYTNRTVNTDKAEVTDVSIEPASPEEIADTVKVMGGEDWELWIQALSEAGVLAEGAKTVAYSYIGPEMTWPVYWSGTIGEAKKDVEKAAKRITQQYGCPAYPVVAKALVTQASSAIPVVPLYICLLYRVMKEKGTHEGCIEQMVRLLTTKLYPENGAPIVDEAGRVRVDDWEMAEDVQQAVKDLWSQVSTANLKDISDFAGYQTEFLRLFGFGIDGVDYDQPVDVEADLPSAAQQ

SEQ ID NO: 120 - DNA, 1912 bp, Euglena gracilis
ttttcgcccgtgcaccacgatgtcgtgccccgcctcgccgtctgctgccgtggtgtctgccggcgccctctgcctgtgcgtggcaacggtattgttggcgactggatccaaccccaccgccctgtccactgcttccactcgctctccgacctcactggtccgtggggtggacaggggcttgatgaggccaaccactgcagcggctctgacgacaatgagagaggtgccccagatggctgagggattttcaggcgaagccacgtctgcatgggccgccgcggggccgcagtgggcggcgccgctcgtggccgcggcctcctccgcactggcgctgtggtggtgggccgcccggcgcagcgtgcggcggccgctggcagcgctggcggagctgcccaccgcggtcacccacctggcccccccgatggcgatgttcaccaccacagcgaaggtcatccagcccaagattcgtggcttcatctgcacgaccacccacccgatcggctgtgagaagcgggtccaggaggagatcgcgtacgcccgtgcccacccgcccaccagccctggcccgaagagggtgctggtcatcggctgcagtaccggctacgggctctccacccgcatcaccgctgccttcggctaccaggccgccacgctgggcgtgttcctggcgggccccccgacgaagggccgccccgccgcggcgggctggtacaacaccgtggcgttcgagaaggccgccctggaggccgggctgtacgcccggagccttaatggcgacgccttcgactccacaacgaaggcgcggacggtcgaggcgatcaagcgggacctcggcacggtggacctcgtggtgtacagcatcgccgccccgaagcggacggaccctgccaccggcgtcctccacaaggcctgcctgaagcccatcggcgccacgtacaccaaccgcactgtgaacaccgacaaggcggaggtgaccgacgtcagcattgagccggcctcccccgaagagatcgcggacacggtgaaggtgatgggcggggaggactgggagctctggatccaggcgctgtcggaggccggcgtgctggcggagggggccaagacggtggcgtactcctacatcggccccgagatgacgtggcctgtctactggtccggcaccatcggggaggccaagaaggacgtggagaaggctgccaagcgcatcacgcagcagtacggctgcccggcgtacccggtggtggccaaggccttggtcacccaggccagctccgccatcccggtggtgccgctctacatctgcctgctgtaccgcgttatgaaggagaagggcacccacgagggctgcatcgagcagatggtgcggctgctcaccacgaagctgtaccccgagaacggggcccccatcgtcgatgaggccggacgtgtgcgggtggatgactgggagatggcggaggatgtgcagcaggctgttaaggacctctggagccaggtgagcactgccaacctcaaggacatctccgacttcgctgggtatcaaactgagttcctgcggctgttcgggttcggcattgacggcgtggactacgaccagcccgtggacgtggaggcggacctccccagtgctgcccagcagtaggtgctggacgccgcctctctccggggggtctgccaaaatggtcgctcccccaacccaaccccctgcccaccatcggggtcccgcgggtgaatgcggcccccacccaaaggcaaaggtcaaggccggggccccaccgccaaagggtaacacatatgtatccgtcgggggctgatccgcgtgcgacacgggccataattgtgccccacgggatgtccatgcgcctaagacaactgccccggccgacagtcgctaccgccttgagttccccaggca

SEQ ID NO: 121 - protein, 447 aa, Streptomyces collinus
MTVKDILDAIQSKDATSADFAALQLPESYRAITVHKDETEMFAGLETRDKDPRKSIHLDEVPVPELGPGEALVAVMASSVNYNSVWTSIFEPVSTFAFLERYGKLSPLTKRHDLPYHIIGSDLAGVVLRTGPGVNAWQPGDEVVAHCLSVELESPDGHDDTMLDPEQRIWGFETNFGGLAEIALVKTNQLMPKPKHLTWEEAAAPGLVNSTAYRQLVSRNGAAMKQGDNVLIWGASGGLGSYATQFALAGGANPICVVSSPQKAEICRSMGAEAIIDRNAEGYKFWKDEHTQDPKEWKRFGKRIRELTGGEDIDIVFEHPGRETFGASVYVTRKGGTITTCASTSGYMHEYDNRYLWMSLKRIIGSHFANYREAYEANRLIAKGKIHPTLSKTYSLEETGQAAYDVHRNLHQGKVGVLCLAPEEGLGVRDAEMRAQHIDAINRFRNV

SEQ ID NO: 122 - DNA, 1344 bp, Streptomyces collinus
gtgaccgtgaaggacatcctggacgcgatccagtcgaaggacgccacgtccgccgacttcgccgccctgcagctccccgagtcgtaccgtgcgatcaccgtgcacaaggacgagacggagatgttcgcgggtctggagacccgcgacaaggacccgcgcaagtcgatccacctcgacgaggtgcccgtgcccgaactgggcccgggcgaagccctggtggccgtcatggcctcctcggtcaactacaactcggtgtggacctcgatcttcgagccggtgtcgacgttcgccttcctggagcgctacggcaagctgtcgccgctgaccaagcgccacgacctgccgtaccacatcatcggctccgacctcgcgggcgtcgtcctgcgcaccggccccggcgtcaacgcctggcagcccggtgacgaggtcgtcgcgcactgcctgagcgtcgagctggagtcgcccgacggccacgacgacaccatgctcgaccccgagcagcgcatctggggcttcgagaccaacttcggcggcctcgcggagatcgcgctggtcaagacgaaccagctgatgccgaagccgaagcacctcacctgggaggaggccgcggccccgggcctggtgaactccaccgcctaccgccagctggtctcccgcaacggcgccgccatgaagcagggcgacaacgtcctgatctggggcgcgagcggcgggctcggctcgtacgccacgcagttcgcgctcgcgggcggtgccaacccgatctgtgtcgtctcctcgccccagaaggcggagatctgccgctcgatgggcgccgaggcgatcatcgaccgcaacgccgagggctacaagttctggaaggacgagcacacccaggaccccaaggagtggaagcgcttcggcaagcgcatccgcgagctgaccggcggcgaggacatcgacatcgtcttcgagcaccccggccgcgagaccttcggcgcctccgtctacgtcacccgcaagggcggcaccatcaccacctgcgcctcgacctcgggctacatgcacgagtacgacaaccggtacctgtggatgtccctgaagcggatcatcggctcgcacttcgccaactaccgcgaggcgtacgaggccaaccgcctgatcgccaagggcaagatccacccgacgctgtcgaagacgtactccctggaggagaccggccaggcggcgtacgacgtccaccgcaacctgcaccagggcaaggtcggcgtcctgtgcctcgcgccggaggaaggcctcggcgtgcgcgacgcggagatgcgcgcccagcacatcgacgccatcaaccgcttccgcaacgtctga

SEQ ID NO: 123 - protein, 447 aa, Streptomyces coelicolor
MTVKDILDAIQSPDSTPADIAALPLPESYRAITVHKDETEMFAGLETRDKDPRKSIHLDDVPVPELGPGEALVAVMASSVNYNSVWTSIFEPLSTFGFLERYGRVSDLAKRHDLPYHVIGSDLAGVVLRTGPGVNAWQAGDEVVAHCLSVELESSDGHNDTMLDPEQRIWGFETNFGGLAEIALVKSNQLMPKPDHLSWEEAAAPGLVNSTAYRQLVSRNGAGMKQGDNVLIWGASGGLGSYATQFALAGGANPICVVSSPQKAEICRAMGAEAIIDRNAEGYRFWKDENTQDPKEWKRFGKRIRELTGGEDIDIVFEHPGRETFGASVFVTRKGGTITTCASTSGYMHEYDNRYLWMSLKRIIGSHFANYREAWEANRLIAKGRIHPTLSKVYSLEDTGQAAYDVHRNLHQGKVGVLCLAPEEGLGVRDREKRAQHLDAINRFRNI

SEQ ID NO: 124 - DNA, 1344 bp, Streptomyces coelicolor
gtgaccgtgaaggacatcctggacgcgatccagtcgcccgactccacgccggccgacatcgccgcactgccgctccccgagtcgtaccgcgcgatcaccgtgcacaaggacgagaccgagatgttcgcgggcctcgagacccgcgacaaggacccccgcaagtcgatccacctggacgacgtgccggtgcccgagctgggccccggcgaggccctggtggccgtcatggcctcctcggtcaactacaactcggtgtggacctcgatcttcgagccgctgtccaccttcgggttcctggagcgctacggccgggtcagcgacctcgccaagcggcacgacctgccgtaccacgtcatcggctccgacctcgccggtgtcgtcctgcgcaccggtccgggcgtcaacgcctggcaggcgggcgacgaggtcgtcgcgcactgcctctccgtcgagctggagtcctccgacggccacaacgacacgatgctcgaccccgagcagcgcatctggggcttcgagaccaacttcggcggcctcgcggagatcgcgctggtcaagtccaaccagctgatgccgaagccggaccacctgagctgggaggaggccgccgctcccggcctggtcaactccaccgcgtaccgccagctcgtctcccgcaacggcgccggcatgaagcagggcgacaacgtgctcatctggggcgcgagcggcggactcggctcgtacgccacccagttcgccctcgccggcggcgccaacccgatctgcgtcgtctcctcgccgcagaaggcggagatctgccgcgcgatgggcgccgaggcgatcatcgaccgcaacgccgagggctaccggttctggaaggacgagaacacccaggacccgaaggagtggaagcgcttcggcaagcgcatccgcgaactgaccggcggcgaggacatcgacatcgtcttcgagcaccccggccgcgagaccttcggcgcctccgtcttcgtcacccgcaagggcggcaccatcaccacctgcgcctcgacctcgggctacatgcacgagtacgacaaccgctacctgtggatgtccctgaagcgcatcatcggctcgcacttcgccaactaccgcgaggcctgggaggccaaccgcctcatcgccaagggcaggatccaccccacgctctccaaggtgtactccctcgaggacaccggccaggccgcctacgacgtccaccgcaacctccaccagggcaaggtcggcgtgctgtgcctggcgcccgaggagggcctgggcgtgcgcgaccgggagaagcgcgcgcagcacctcgacgccatcaaccgcttccggaacatctga

SEQ ID NO: 125 - protein, 566 aa, Streptomyces cinnamonensis
MDADAIEEGRRRWQARYDKARKRDADFTTLSGDPVDPVYGPRPGDTYDGFERIGWPGEYPFTRGLYATGYRGRTWTIRQFAGFGNAEQTNERYKMILANGGGGLSVAFDMPTLMGRDSDDPRSLGEVGHCGVAIDSAADMEVLFKDIPLGDVTTSMTISGPAVPVFCMYLVAAERQGVDPAVLNGTLQTDIFKEYIAQKEWLFQPEPHLRLIGDLMEHCARDIPAYKPLSVSGYHIREAGATAAQELAYTLADGFGYVELGLSRGLDVDVFAPGLSFFFDAHVDFFEEIAKFRAARRIWARWLRDEYGAKTEKAQWLRFHTQTAGVSLTAQQPYNNVVRTAVEALAAVLGGTNSLHTNALDETLALPSEQAAEIALRTQQVLMEETGVANVADPLGGSWYIEQLTDRIEADAEKIFEQIRERGRRACPDGQHPIGPITSGILRGIEDGWFTGEIAESAFQYQRSLEKGDKRVVGVNCLEGSVTGDLEILRVSHEVEREQVRELAGRKGRRDDARVRASLDAMLAAARDGSNMIAPMLEAVRAEATLGEICGVLRDEWGVYVEPPGF

SEQ ID NO: 126 - DNA, 4362 bp, Streptomyces cinnamonensis
tgaggcgctggatcgcctcggagagcagctggtaacggtccgcgtggtactcggccggggtgcagccgtccacgatgtgcgggatcgcgtcgggctcgaggatcaccagggcgggggcgtcgccgatcgcgtcggcgaacgtgtccacccagctccggtaggcctccgcactggccgcgccgcccgcggagtgctgaccgcagtcgcggtgcgggatgttgtacgcgacgagtacggcggtgcggtcctccttgaccgcgccccgcgtcgccttcgcgacgtcgggcgccggatcgtccccggccggccacacggccatggcccgttcggagatgcgcctgagcgtctcggcgtcctcggcgcggccctgttcctcccactgcctgacctggcgcgcggcggggctgtcggggtcgacccagaaggtgccggcggggggcccggcgctcgcggtggcgggcttgcgcacggccgcctcctccttcgtgccgtcggaccccgggtctgaggaggagcagcctgccgggagcccgagggcggcgagggccgcgagtgccgtgaacgtgcggagcagccggtgcatccagcccccttgggcgatggtgacagtgacggtcagtcagcccggcaatcgttacataaaggactattcaagctcttgtgccacaccgcctccggtgccgagcgcgaacccggcgggcaccagagccccgccgcggccgcggagccgtacgtacgaccgaattgcgagacggggctgaccaccatatgaccggcgggtaaggtcgatgccgtgccgaagccgctcagcctccccttcgatcccatcgcccgcgccgacgagctctggaagcagcgctggggatcggtcccggccatgggcgcgatcacctcgatcatgcgggcgcaccagatcctgctcgccgaggtcgacgcggtcgtcaagccgtacggactgaccttcgcgcgctacgaggcgctggtgctcctcaccttctcgcaggccggcgagttgccgatgtcgaagatcggcgagcggctcatggtgcacccgacctcggtcacgaacaccgtggaccgcctggtgaagtccggcctggtcgacaagcgcccgaaccccaacgacggccgcggcacgctcgcctccatcacggagaagggccgcgaggtcgtcgaggcggccacccgcgagctgatggcgatggacttcgggctcggggtgtacgacgcggaggagtgcggggagatcttcgcgatgctgcggcccctgcgggtggcggcgcgcgatttcgaggagcagtagggcccgcccggtgagaagtgggatcgggtcgtcccggtacgggcgggggcggcgaagatcgcgtgaaaagggcggttacgctcgtagccatgaaacgcagcgtgctgacccgctaccgggtgatggcctacgtcaccgccgtcatgctcctcatcctgtgcgcctgcatggtggccaagtacggcttcgacaagggcgagggtctgaccctcgtcgtgtcgcaggtgcacggcgtgctctacatcatctacctgatcttcgccttcgacctgggctccaaggcgaagtggccgttcggcaagctgctctgggtgctggtctcgggcacgatcccgaccgccgccttcttcgtcgagcgcaaggtcgcccgtgacgtcgagccgctgatcgccgacggctccccggtcaccgcgaaggcgtaacccgcaccgccacggacaggtccgtggcggttggccatcgacttttactaggacgtcctagtaaattcgatggtatggacgctgacgcgatcgaggaaggccgccgacgctggcaggcccgttacgacaaggcccgcaagcgcgacgcggacttcaccacgctctccggggaccccgtcgaccccgtctacggcccccggcccggggacacgtacgacgggttcgagcggatcggctggccgggggagtaccccttcacccgcgggctctacgccaccgggtaccgcggccgcacctggaccatccgccagttcgccggcttcggcaacgccgagcagacgaacgagcgctacaagatgatcctggccaacggcggcggcggcctctccgtcgccttcgacatgccgaccctcatgggccgcgactccgacgacccgcgctcgctcggcgaggtcggccactgcggtgtcgccatcgactccgccgccgacatggaggtcctcttcaaggacatcccgctcggcgacgtcacgacgtccatgaccatcagcgggcccgccgtgcccgtcttctgcatgtacctcgtcgcggccgagcgccagggcgtcgacccggccgtcctcaacggcacgctgcagaccgacatcttcaaggagtacatcgcccagaaggagtggctcttccagcccgagccgcacctgcgcctcatcggcgacctgatggagcactgcgcgcgcgacatccccgcgtacaagccgctctcggtctccggctaccacatccgcgaggccggggcgacggccgcgcaggagctcgcgtacaccctcgcggacggcttcgggtacgtggaactgggcctctcgcgcggcctggacgtggacgtcttcgcgcccggcctctccttcttcttcgacgcgcacgtcgacttcttcgaggagatcgcgaagttccgcgccgcacgccgcatctgggcgcgctggctccgggacgagtacggagcgaagaccgagaaggcacagtggctgcgcttccacacgcagaccgcgggggtctcgctcacggcccagcagccgtacaacaacgtggtgcggacggcggtggaggccctcgccgcggtgctcggcggcacgaactccctgcacaccaacgctctcgacgagacccttgccctccccagcgagcaggccgcggagatcgcgctgcgcacccagcaggtgctgatggaggagaccggcgtcgccaacgtcgcggacccgctgggcggctcctggtacatcgagcagctcaccgaccgcatcgaggccgacgccgagaagatcttcgagcagatcagggagcgggggcggcgggcctgccccgacgggcagcacccgatcgggccgatcacctccggcatcctgcgcggcatcgaggacggctggttcaccggcgagatcgccgagtccgccttccagtaccagcggtccctggagaagggcgacaagcgggtcgtcggcgtcaactgcctcgaaggctccgtcaccggcgacctggagatcctgcgcgtcagccacgaggtcgagcgcgagcaggtgcgggagcttgcggggcgcaaggggcggcgtgacgatgcgcgggtgcgggcctcgctcgacgcgatgctcgccgctgcgcgggacgggtcgaacatgattgcccccatgctggaggcggtgcgggccgaggcgaccctcggggagatctgcggggtgcttcgcgatgagtggggggtctacgtggagccgcccgggttctgagggcgcgctccctttgcctgcgggtctgctgtggctggtcgcgcagttccccgcacccctgaaagaccccggcgctttcccttcctggctcgcctcgtcgctgtctgcggggccgtgggggctggtcgcgcagttccccgcgcccctgcccgcacctgcgccccgccgcctgcatgccgcccccaccctgacgggggcgttcggggcccaccctgacgggtgcggtcggggcgtgccggggtcttttaggggcgcggggaactgcgcgagcaacccccacccacccgcaggtgcacgcggagcggcggacgccccgcagacgggggcaaaacgggcggagtgcccccgcccgccgggcggcgcgaattcgtaggtttaaggggcaggggtcagggcaggcgccgagccggtcaaccgcccccgtcccaggagaccccgtgacctcgaccggccacgcccgcaccgccgccatcgccatcggagccgccaccgccaccgtcctcggcgcgctgctggtcggcggctccggcgaggtgagtgcgagcccgccgcccgagcccaaggtccaggacgacttcgactccctcggccccgaggtgcgcgccgcgaagctctccgacgggcggacggcccactactcggacacgggcgacaaggacggcaagccggccctgttcatcggcggcaccggcacgagcgcccgcgcctcccacatgaccgacttcttccgctcgacgcgcgaggacctgggcctgcgcctcatctccgtggagcgcaacggcttcggcgacaccgcgttcgacgagaagctgggcaccgccgacttcgcgaaggacgccctcgaagtcctcgaccggctcgg

SEQ ID NO: 127 - protein, 136 aa, Streptomyces cinnamonensis
MGVAAGPIRVVVAKPGLDGHDRGAKVIARALRDAGMEVIYTGLHQTPEQVVDTAIQEDADAIGLSILSGAHNTLFARVLELLKERDAEDIKVFGGGIIPEADIAPLKEKGVAEIFTPGATTTSIVEWVRGNVRQAV

SEQ ID NO: 128 - DNA, 1643 bp, Streptomyces cinnamonensis
gtcgacctcccgtttggcgcacggaagggaggctctgtcccccgtgtgccctagggggagtcgtggtcgaggagtcggctgtgcgatggcgatcccggccaccgccctgcggtgactccgtgcccccgttgcatcgccgatgcgcggtgtcaccacgccgtgcggctgccggcgcggtggcccggcgtctcgttgcggctcccctcgcgcctggtccggatgcggagcgtgaacccctgggttacggacgggcgcgcagcgaacgtgtcccacgtgtgatttccccctcgctctccaccgcgaaactgccgcttgcgcgatgctggggataacgttcgttcacttccccggccggtgcggtgcggggtatctgtgccgggacagactttgtcggtacggatatcggtacatggaggcagtgatgggtgtggcagccgggccgatccgcgtggtggtcgccaagccggggctcgacgggcacgatcgcggggccaaggtgatcgcgcgggcgttgcgtgacgcgggtatggaggtcatctacaccgggctgcaccagacgcccgagcaggtggtggacaccgcgatccaggaggacgccgacgcgatcggcctctccatcctctccggagcgcacaacacgctgttcgcgcgcgtgttggagctcttgaaggagcgggacgcggaggacatcaaggtgtttggtggcggcatcatcccggaggcggacatcgcgccgctgaaggagaagggcgtcgcggagatcttcacgcccggggccaccaccacgtcgatcgtggagtgggttcgggggaacgtgcgacaggccgtctgaggcattccccgtcgcccgtctgccgtggtcggcgtcatatcggcggacatcgtctcggtggacgtcatggcggcggggggagttcgtcgcgtatcgccgcgcggaggcgcagggtggtgaccaggcgctggaacgcttccgaccagtagctgcccgcgccgggtgacgcgtcctccgcttcgtcggggaccgcggtgagcgcttccaggcggaccgcctcggccgggtccagacagcgttccgccaggcccatcactccgctgaagctccatgggtaactgcccgcgtcgcgcgcgatgttcagggcgtccaccacggcccggccgagagggccggcccagggcaccgcgcagacgccgagcagttggaacgcctccgacaggccgtgtgccgctatgaaccccgccacccagtccgcgcgctcggcggcaggcatggaggcgagcagtttggcccgctcggcgagggacacggcgccaggccccgccgcgtcgggtgaggcgggggcgccgagcagcgctctggaccaggcgacgtcacgctggcgtacggccgcgcggcaccatgcggcgtgcagttcgccccgccagtcgtcggccaccgggagcgccacgatctccgccggggtgcggttgccgagccggggcggccaggtggcgagcggggccgattccacgagctggccgagccaccaggagcgctcgccccggccggtggggggcttcgggacgacgccgtcccgctccatgcccgcgtcgcactcgtgcggcgcctcgacggtgagggtcggcgtgctcgatgtgtggtcgac

SEQ ID NO: 129 - protein, 566 aa, Streptomyces coelicolor
MDAHAIEEGRLRWQARYDAARKRDADFTTLSGDPVEPVYGPRPGDEYEGFERIGWPGEYPFTRGLYPTGYRGRTWTIRQFAGFGNAEQTNERYKMILRNGGGGLSVAFDMPTLMGRDSDDPRSLGEVGHCGVAIDSAADMEVLFKDIPLGDVTTSMTISGPAVPVFCMYLVAAERQGVDASVLNGTLQTDIFKEYIAQKEWLFQPEPHLRLIGDLMEYCAAGIPAYKPLSVSGYHIREAGATAAQELAYTLADGFGYVELGLSRGLDVDVFAPGLSFFFDAHLDFFEEIAKFRAARRIWARWMRDVYGARTDKAQWLRFHTQTAGVSLTAQQPYNNVVRTAVEALAAVLGGTNSLHTNALDETLALPSEQAAEIALRTQQVLMEETGVANVADPLGGSWFIEQLTDRIEADAEKIFEQIKERGLRAHPDGQHPVGPITSGLLRGIEDGWFTGEIAESAFRYQQSLEKDDKKVVGVNVHTGSVTGDLEILRVSHEVEREQVRVLGERKDARDDAAVRGALDAMLAAARSGGNMIGPMLDAVRAEATLGEICGVLRDEWGVYTEPAGF

SEQ ID NO: 130 - DNA, 1701 bp, Streptomyces coelicolor
atggacgctcatgccatagaggagggccgccttcgctggcaggcccggtacgacgcggcgcgcaagcgcgacgcggacttcaccacgctctccggagaccccgtggagccggtgtacgggccccgccccggggacgagtacgagggcttcgagcggatcggctggccgggcgagtaccccttcacccgcggcctgtatccgaccgggtaccgggggcgtacgtggaccatccggcagttcgccgggttcggcaacgccgagcagaccaacgagcgctacaagatgatcctccgcaacggcggcggcgggctctcggtcgccttcgacatgccgaccctgatgggccgcgactccgacgacccgcgctcgctgggcgaggtcgggcactgcggggtggccatcgactcggccgccgacatggaagtgctgttcaaggacatcccgctcggggacgtgacgacctccatgacgatcagcgggcccgccgtgcccgtgttctgcatgtacctcgtcgccgccgagcgccagggcgtcgacgcatccgtgctcaacggcacgctgcagaccgacatcttcaaggagtacatcgcccagaaggagtggctcttccagcccgagccccacctccggctcatcggcgacctcatggagtactgcgcggccggcatccccgcctacaagccgctctccgtctccggctaccacatccgcgaggcgggcgcgacggccgcgcaggagctggcgtacacgctcgccgacggcttcggatacgtggagctgggcctcagccgcgggctcgacgtggacgtcttcgcgcccggcctctccttcttcttcgacgcgcacctcgacttcttcgaggagatcgccaagttccgcgcggcccgcaggatctgggcccgctggatgcgcgacgtgtacggcgcgcggaccgacaaggcccagtggctgcggttccacacccagaccgccggagtctcgctcaccgcgcagcagccgtacaacaacgtcgtacgcaccgcggtggaggcgctggcggccgtgctcggcggcaccaactccctgcacaccaacgcgctcgacgagaccctcgccctgcccagcgagcaggccgccgagatcgccctgcgcacccagcaggtgctgatggaggagaccggcgtcgccaacgtcgccgacccgctgggcggttcctggttcatcgagcagctgaccgaccgcatcgaggccgacgccgagaagatcttcgagcagatcaaggagcgggggctgcgcgcccaccccgacgggcagcaccccgtcggaccgatcacctccggcctgctgcgcggcatcgaggacggctggttcaccggcgagatcgccgagtccgccttccgctaccagcagtccttggagaaggacgacaagaaggtggtcggcgtcaacgtccacaccggctccgtcaccggcgacctggagatcctgcgggtcagccacgaggtcgagcgcgagcaggtgcgggtcctgggcgagcgcaaggacgcccgggacgacgccgccgtgcgcggcgccctggacgccatgctggccgcggcccgctccggcggcaacatgatcgggccgatgctggacgcggtgcgcgcggaggcgacgctgggcgagatctgcggtgtgctgcgcgacgagtggggggtgtacacggaaccggcggggttctga

SEQ ID NO: 131 - protein, 138 aa, Streptomyces coelicolor
MGVAAGPIRVVVAKPGLDGHDRGAKVIARALRDAGMEVIYTGLHQTPEQIVDTAIQEDADAIGLSILSGAHNTLFAAVIELLRERDAADILVFGGGIIPEADIAPLKEKGVAEIFTPGATTASIVDWVRANVREPAGA

SEQ ID NO: 132 - DNA, 417 bp, Streptomyces coelicolor
atgggtgtggcagccggtccgatccgcgtggtggtggccaagccggggctcgacggccacgatcgcggggccaaggtgatcgcgagggccctgcgtgacgccggtatggaggtgatctacaccgggctccaccagacgcccgagcagatcgtcgacaccgcgatccaggaggacgccgacgcgatcgggctgtccatcctctccggtgcgcacaacacgctcttcgccgccgtgatcgagctgctccgggagcgggacgccgcggacatcctggtcttcggcggcgggatcatccccgaggcggacatcgccccgctgaaggagaagggcgtcgcggagatcttcacgcccggcgccaccacggcgtccatcgtggactgggtccgggcgaacgtgcgggagcccgcgggagcatag

SEQ ID NO: 133 - protein, 566 aa, Streptomyces avermitilis
MDADAIEEGRRRWQARYDASRKREADFTTLSGDPVEPAYGPRPGDAYEGFERIGWPGEYPFTRGLYPTGYRGRTWTIRQFAGFGNAEQTNERYKKILANGGGGLSVAFDMPTLMGRDSDDRRALGEVGHCGVAIDSAADMEVLFKDIPLGDVTTSMTISGPAVPVFCMYLVAAERQGVDPSVLNGTLQTDIFKEYIAQKEWLFQPEPHLRLIGDLMEHCASKIPAYKPLSVSGYHIREAGATAAQELAYTLADGFGYVELGLSRGLDVDVFAPGLSFFFDAHVDFFEEIAKFRAARRIWARWLRDVYGAKSEKAQWLRFHTQTAGVSLTAQQPYNNVVRTAVEALAAVLGGTNSLHTNALDETLALPSEQAAEIALRTQQVLMEETGVANVADPLGGSWYVEQLTDRIEADAEKIFEQIRERGLRAHPDGRHPIGPITSGILRGIEDGWFTGEIAESAFQYQQALEKGDKRVVGVNVHHGSVTGDLEILRVSHEVEREQVRVLGERKSGRDDTAVTAALDAMLAAARDGSNMIAPMLDAVRAEATLGEICDVLREEWGVYTEPAGF

SEQ ID NO: 134 - DNA, 1701 bp, Streptomyces avermitilis
tcagaaaccggcgggctccgtgtagaccccccactcctcccggaggacatcgcagatctcgcccagcgtggcctccgcgcggaccgcgtccagcatcggggcgatcatgttcgacccgtcgcgcgcggcggcgagcatcgcgtccagggccgcggttacggccgtgtcgtcgcgccccgacttccgctcgcccagcacccgcacctgctcgcgctccacctcgtggctgacgcgcaggatctccaggtcgcccgtcacggacccgtggtggacgttgacgccgacgacccgcttgtcgcccttctccagcgcctgctggtactggaaggccgactcggcgatctccccggtgaaccagccgtcctcgatgccgcgcaggatgccggaggtgatgggcccgatcgggtgccgcccgtccgggtgggcccgcagcccgcgctccctgatctgttcgaagatcttctcggcgtcggcctcgatccggtcggtcagctgctccacgtaccaggaaccgcccagcggatcggccacgttggcgacgcccgtctcctccatcagcacctgctgggtgcgcagggcgatctcggccgcctgctcggacggcagggcgagggtctcgtcgagggcgttggtgtgcagcgagttcgtcccgccgagcaccgcggcgagggcctccacggccgtccgtacgacgttgttgtacggctgctgcgcggtgagcgagacgcccgcggtctgggtgtggaagcgcagccactgcgccttctccgacttcgccccgtacacgtcccgcagccagcgcgcccagatgcgccgcgccgcacggaacttggcgatctcctcgaagaagtcgacgtgcgcgtcgaagaagaaggagagcccgggcgcgaacacgtccacgtccaggccgcggctcagccccagctccacgtatccgaaaccgtcggcgagggtgtacgccagctcctgggcggccgtggcaccggcctcccggatgtggtacccggagacggacagcggcttgtacgcggggatcttcgaggcgcagtgctccatcaggtcgccgatgagccgcagatggggctcgggctggaagagccactccttctgcgcgatgtactccttgaagatgtcggtctggagggtgccgttgaggacggaggggtcgacgccctgccgctcggccgcgaccaggtacatgcagaagacgggcacggcgggcccgctgatcgtcatcgacgtcgtcacgtcacccagcgggatgtccttgaacaggacctccatgtcggccgccgagtcgatcgcgaccccgcagtgcccgacctcgccgagcgcgcggcggtcgtcggagtcgcgccccatgagcgtcggcatgtcgaaggccacggacagcccaccgccgccgttggcgaggatcttcttgtagcgctcgttggtctgctcggcgttgccgaacccggcgaactgccggatggtccaggtccggccccggtagccggtcggatacagaccgcgcgtgaaggggtactcacccggccagccgatccgctcgaaaccctcgtacgcgtccccgggccggggcccgtacgccggctccacgggatcgccggagagcgtggtgaaatcggcctcgcgcttgcgtgaggcgtcgtagcgggcctgccagcgtcggcggccttcctcgatggcgtcagcgtccat

SEQ ID NO: 135 - protein, 138 aa, Streptomyces avermitilis
MGVAAGPIRVVVAKPGLDGHDRGAKVIARALRDAGMEVIYTGLHQTPEQIVGTAIQEDADAIGLSILSGAHNTLFAAVIDLLKERDAEDIKVFGGGIIPEADIAPLKEKGVAEIFTPGATTASIVEWVRANVRQPAGA

SEQ ID NO: 136 - protein, 1701 aa, Streptomyces avermitilis
TCAGAAACCGGCGGGCTCCGTGTAGACCCCCCACTCCTCCCGGAGGACATCGCAGATCTCGCCCAGCGTGGCCTCCGCGCGGACCGCGTCCAGCATCGGGGCGATCATGTTCGACCCGTCGCGCGCGGCGGCGAGCATCGCGTCCAGGGCCGCGGTTACGGCCGTGTCGTCGCGCCCCGACTTCCGCTCGCCCAGCACCCGCACCTGCTCGCGCTCCACCTCGTGGCTGACGCGCAGGATCTCCAGGTCGCCCGTCACGGACCCGTGGTGGACGTTGACGCCGACGACCCGCTTGTCGCCCTTCTCCAGCGCCTGCTGGTACTGGAAGGCCGACTCGGCGATCTCCCCGGTGAACCAGCCGTCCTCGATGCCGCGCAGGATGCCGGAGGTGATGGGCCCGATCGGGTGCCGCCCGTCCGGGTGGGCCCGCAGCCCGCGCTCCCTGATCTGTTCGAAGATCTTCTCGGCGTCGGCCTCGATCCGGTCGGTCAGCTGCTCCACGTACCAGGAACCGCCCAGCGGATCGGCCACGTTGGCGACGCCCGTCTCCTCCATCAGCACCTGCTGGGTGCGCAGGGCGATCTCGGCCGCCTGCTCGGACGGCAGGGCGAGGGTCTCGTCGAGGGCGTTGGTGTGCAGCGAGTTCGTCCCGCCGAGCACCGCGGCGAGGGCCTCCACGGCCGTCCGTACGACGTTGTTGTACGGCTGCTGCGCGGTGAGCGAGACGCCCGCGGTCTGGGTGTGGAAGCGCAGCCACTGCGCCTTCTCCGACTTCGCCCCGTACACGTCCCGCAGCCAGCGCGCCCAGATGCGCCGCGCCGCACGGAACTTGGCGATCTCCTCGAAGAAGTCGACGTGCGCGTCGAAGAAGAAGGAGAGCCCGGGCGCGAACACGTCCACGTCCAGGCCGCGGCTCAGCCCCAGCTCCACGTATCCGAAACCGTCGGCGAGGGTGTACGCCAGCTCCTGGGCGGCCGTGGCACCGGCCTCCCGGATGTGGTACCCGGAGACGGACAGCGGCTTGTACGCGGGGATCTTCGAGGCGCAGTGCTCCATCAGGTCGCCGATGAGCCGCAGATGGGGCTCGGGCTGGAAGAGCCACTCCTTCTGCGCGATGTACTCCTTGAAGATGTCGGTCTGGAGGGTGCCGTTGAGGACGGAGGGGTCGACGCCCTGCCGCTCGGCCGCGACCAGGTACATGCAGAAGACGGGCACGGCGGGCCCGCTGATCGTCATCGACGTCGTCACGTCACCCAGCGGGATGTCCTTGAACAGGACCTCCATGTCGGCCGCCGAGTCGATCGCGACCCCGCAGTGCCCGACCTCGCCGAGCGCGCGGCGGTCGTCGGAGTCGCGCCCCATGAGCGTCGGCATGTCGAAGGCCACGGACAGCCCACCGCCGCCGTTGGCGAGGATCTTCTTGTAGCGCTCGTTGGTCTGCTCGGCGTTGCCGAACCCGGCGAACTGCCGGATGGTCCAGGTCCGGCCCCGGTAGCCGGTCGGATACAGACCGCGCGTGAAGGGGTACTCACCCGGCCAGCCGATCCGCTCGAAACCCTCGTACGCGTCCCCGGGCCGGGGCCCGTACGCCGGCTCCACGGGATCGCCGGAGAGCGTGGTGAAATCGGCCTCGCGCTTGCGTGAGGCGTCGTAGCGGGCCTGCCAGCGTCGGCGGCCTTCCTCGATGGCGTCAGCGTCCAT

SEQ ID NO: 137 - protein, 139 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMI

SEQ ID NO: 138 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 139 - protein, 533 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVI

SEQ ID NO: 140 - DNA, 1000 bp, Artificial
  IMA1
ggaacggggctgtatgtttatgattgctcgaatcacgtttttcttgttttttcgtcaagaattccagtcaagttttccaccaccttgacccttaaagcatcgacttttgtgctcttgaatgtgtttctaagaatacttgtaaaggacaccctctaatttcgtgtgcacttttcacatattatcaagacaatcgttcctgtactcagatgcactgttactgtaaagactactatacaacaagcgaaaaatgatgttcgaaaacctttatttctattttgaaaggcatgtgtctcgaggtccttgctttattgtgggtggtcatgccattctgtaaaccttacggtactgctccgtctatatctttgaggttgttatttccccacaaatatgcgtttctaaccgaatattcattcagtcggaccggacaatagctcttaactgcgtttaccggagtaaatatcgtaagaatttgcatgcggtgaaatacagggaaaataagaaattacaccctaatacaaaaagaaaactaagtttcacaatacgtaaggatattttagtggggagaatatttcggagaataaagtttccaactccgcggtgtgaacaaccgctcagcacgcagcgttattctcgagaaaagtggccctgaaataaggaaataaagttactaatgttttttcgctgtacgatatcaaatgtgacgaagtaggcaccccacgctataaattggctactaaagtttatgtcagtacttgggatcgttgaaatactcggataaattatgttccttatttttcatggttttcgtcataccacagtttaccccagaatgagaaaggatctccttttgaaataaaaagtacttaagggcaatgatattgagttgctagacgtttggttagacgcctgttttgaaataaaaaagctgtctcaaattaatcgagcaagcacagatcaaacaagatacaaacaaagcttttcaacgtaatatttactatcg

SEQ ID NO: 141 - DNA, 1000 bp, Artificial
  HXK2
ccattccacaactttcatttagcactactgggacaagcagtagtgaaagcgttgatagcactacggcacaaaccccaactgatccagagagttactggtcggataaccggtgcaaacatagtgattgtcaagagcttagtccattcgcatctgtatttgatctcattgaccactatgaccacacgcacgccttcattcctgagacgctggtaaagtacagctacattcatttatataagcctagcgtctgggatttattcgaatactgaacgccatagaagagcaatttccgtcctctactcatgtgattcgaactatgaaacaaagaaaaggcaagagtaaatagcgtgatacctattacgtattacgtatacatcctattattcttgaaaaaaagtgcggggctccagagctccacattggtgaccccagagtatactgctctttctaatgccttttccatcatgttactacgagttttctgaacctcctcgcacattggtacctagaaatggctatcatgccggacggcaccgggcaataaaccggacggcacaaaaaaatcgaagaaaagagatttctttttctcgcgggcagtttttccggtcgatcgacattcgtacggtactttctctgtttcagggacatcatgttgtaaaagaaaaagacagtttaggtaatcgttcttttctttctgaaaaattttccacgacgacgacgacgaccacgaaacacctttgattgcgagatccacgaaattacctcctgctgaggcgagcttgcaaatatcgtgtccaattccgtgatgtctctttgttgcaccttcgccactgtcttatctacaaaactataaaaaagagtaatcctaccccatatctaaaaaaaattccttaacttttataacttaacttcaaagtttcttaatattttttcgctttttctttgaaaaggttgtaggaatataattctccacacataataagtacgctaattaaataaa

SEQ ID NO: 142 - DNA, 1000 bp, Artificial
  SLT2
gtggtgaaaatgaaggaaatttacaagattgtggatgacgaagttgtcatggacatgagattagtgagtcgggtcattggtaatcccttgttaaaggaatcaaaggagtttcgtcaagatttgaatgccaggccattagctagattggaacgtttgaaaatcttgataaactatgcagttaagatctctccgcataaggaaaaattcccctatgtgaggtggacagtgggtaaaaacaagtacatacatgagctcatggtcccagagcgctttcccattgatattcccagagaaaatgtcgggttagaaagaactcagattccattaatgctatgctgggcactgtccattcataaggcacagggtcaaactattcaaagactaaaggtcgacttgaggagaattttcgaagccggccaagtttatgttgcactgtcaagagcggtaactatggacaccttacaggtcctaaactttgatccaggaaagattcgcaccaatgaaagagtaaaagatttctataaacgtttagaaactttgaaatgacttgcaacgaataaatgcatatactctagttgaagttttcttttcttgttctatacaggttcgaatacttgtgagcctatctgtataatttaacagaatcccgaaatattcatctagaagccatctatttagctaagcctacgtatgcggcgatttttatattatctttttttttttttatagaagactgcgaaatgttggcagaatggaaagtttcagtgttaaaaatagaaactgaaaaaggagatctagccaggaatatatcgaaaaaaaaagtgagggaaatcagatcctacacaaatatttagatttaattgaagaccctggtctgccagatatatatatatattagacgaactgtgcattcagtcagcaaatctaggccacagattttcttattgaagctatcaaaatagtagaaataattgaagggcgtgtataacaattctgggag

SEQ ID NO: 143 - DNA, 1000 bp, Artificial
  YHR210c
cataaaactgtaagaattgtaaagcaaaactggtgcactgctacatcaactcttatcttcttgcatataaatttaaatgaaaaggaactactttgtaattatcgatattacattgaaacctatgaggaagattatgacatgataacactaaactattgctggccagcacccgaaccgagtgtccaaattgagttttgaatcagttttcagctcagaacagattccccttttcctttattaggtcgtatcatcattctatgtgcaactactgcagcatttgcgtataattatggaaataaaattatacgaaagttgatacttggttgtaaatggcctaagaatcggaaaaaatggaattctattggcatgctatcttgtttaatgagattatgaagttgaatatcatttctgcgttttgcattcaaacaatatcatttcaaaggcctatcgctgtgagcaatacgctggatttgctcatcgcacagtaagcctgcactaccccaccaaattacaagaatatagtagagatcagaagcttatgagaagtcacttccaaaattcgcgttgtccaacatccttggaataatttttcctccttatgcatccaggtgattgacactttttgacgggataaatgcaggtggaggtgggggaggggtaaagtttcgtaaagagtgtcaggtcgcatatctttgcactgcgcagaaattctcgcagaaaattacgctacggagaaattctcgggcactaatatcgtacaaaaattaggtttgttacgtgataatatggccttgtacctgttaagtttttccgacaattagttactagctgaatatcttaaaaaaaggtaaaagtaactcctccatggtttggttattcatgcgtaaacaccttggatgctctgagatataaaatcagaatgtactacgaagtactggaactcaattgtacattatgttactgcaataagtaaattcacctaaaaagccaaaaagtgata

SEQ ID NO: 144 - DNA, 1000 bp, Artificial
  YJL171c
atgaaaacaaggaatatacggggaacatataaagggtcagcgtcgttgactagtctgtcatttatattgtgcttgtacataggactacaaaaattcaaagaatgacgacaagaaacatgactactttagcatcaagtattgagcataaaacaaaacatctagcgcgcccttcgagaacgatgagaacccttggatgaaaaaatactgttgccaatgcaaatcatgtaaaatgagtgtgcctgtccaaccttggctgccaaggttttttgtttttggaatcttgtgccccgttttctggttggtgaatcttttagcctggtggttcttacagtattggcaaccacatgaattggaattccacgacttgcaagaagacgaatacccaggattttatgaatatgaagccataactaaaagaacggtgatacccataaaggaagaagtcctccaagagattcgcgtcatgcagaatttcagtgatagcaacagcgaagaatattacgagagcaaagacggtatgccgtcgtctttcctaaacgtgaacacggaacaagtcgaggacgagaatgacaccttgaaaaaatatcgttacgcgtttttgaagaaggtagcccacgatgtgctggagtcgcacgatttattacgtaagaccttccgcgactggaatttacggtctttgcttggcctcctcatcgattctatactcataatatttgtagttctcctatgtaagaaaagccgttaggtagatctaaagacagaaaatgatatcagcctctttcttttccacagcctccatttcccatttttgctgtatctgcaagggttcctttttccatttttttttttcaaagtcttggctccgcccttttcttttgtctattttgccgagcttaggttatttataaacctgaaaatcctcgagaaacaatccttatcgaaggaagcagccataatagaacatactcaagtgcaaacattacaagcttaaataagacaa

SEQ ID NO: 145 - DNA, 1000 bp, Artificial
  PUN1
gcccctctgtcgctgtagaatcttagatttgccatggtaaagacctacggactgatcgataaagatatctttttcaccttctcgaagaagaggttggcccgatgacgtagtttccacataatgccagtactccatcttttgaaaaaaaaagaatgactttcaaaacacacttcctgattcctagccgaggtcccctattctatcttggatgaccttttctctgcttttttgtttttcagtctccatcttttccagatgaaacatgtgaaaccctttttcctcttcgttgatcctaaaaaaagcgcgtctggaaaacaaggcgaagcttcctcacatggaaaaggcttcttaatatgtcgctacgcctcattcccattgcatacagaaagcaaagtagtgcgttttgcgaacgtcacagatcaaaagtttggccatgcattgtcattctttttttcttacatacactgcaccagacatgtcggttccgccccgctaacggttagtcagccacacattgacgtacactgtgaacagcctatttctttccatgtatctcagtgcccagcttatgagaactgtcacagcctcccacttgaccctcagagccctctccactccccccctctttcaacatcgccagatagccgccgttgaatggtgcgggacaacccggcctggcctggccaggcaaaaaaggacgcagcacgcctcgagcgttatttccaaatcgggcgtactatcagccaagcccagctcggtatttttagcgcttctcgcaggaaaattggctgagaagtatatatacgcgagaatgttgctcttccatgtctcagtagtcaatgagtgtccagtggtgtttcattctggaccagttgtttggaagtagaactaaaagaaactagatcaagatcatacaacgctgcgcagtagtgaaacttgattaaagcaatagagaactattaagaaaaaaacaaacacatcatcgaaggacgctataagc

SEQ ID NO: 146 - DNA, 1000 bp, Artificial
  PRE8
tatttttggatagtttcaataggaacatcacgtattatgaaagtccggaaaatacattacaattcgccaatattttatccagccaaacaagcttcataaatttactatcgacgtacaacttaattgcccattcagatcacctcatgaacttcaacgtcggtggaatggcagcaaaagttaaaaaagaaatcctgaatcaaatgctaaacaatttgtatgattccatcagactattgtctcccagcattgaaaatgacaaatcaatgaaggaaaaattgagagaaaaagtaaagaactactgcagattcaaagcttatttgaagtcacctgaattggacatggatgaactgaagaccttggtttcagtcgagtcttttttaaatcctttcactccttcaatgttgttcaataacttgatcgaaactatttatataaacgaacacgcttcctcgttagtccttcagaatgggttgatctattcactccaacagaaaggtctcaataagatactgagctatctagaagaaagcttcatcactagtggaaatgatgccaatattgaaaaggtcagggaattcaggtcccttttaaggaagagcaagcctcttcaagcatgacctttacaatttgatattttatttatttcactgttataacataattacaagtaattaatgtcatataataataataataataataataataataataataataataataataataataataataataataataataataataataataataataataataataataataatagtaataataacgtctatataagaagtatctacaccattgcttacgcttttattttttcctttcgacgtgaaaagcgataatagcttattaaggtggcaaaattgtccccggccccaataagctgagagtggaataggtgaagcattttatatttttagtttcaattagtagtaagcaaccataagacaccaatcaacacagttctataatt

SEQ ID NO: 147 - DNA, 1000 bp, Artificial
  COS3
aatttatatacacttatgccaatattacaaaaaaatcaccactaaaatcacctaaacataaaaatattctatccttcaaccataatacataaacacacttaattgcgtcttaatactatcatggtatcattaacttaaagttccttaatatcgtcataccactatgctctattccatatattgtaatataactgtactctatagtcatacagacgcttttacttcaccccatcttatactattgtcatagaatctcacactgacgcatgattaaaacgaataatttttactgtaagggctgccatccgcgctctatccttttgtttgcaatatttatatacagaatctcaaaacaagcgggagaagtgctaattacccagaggtcatgcatgatctgagtaccaccgtacctctaggttttgctttgatccgttttacagtgacaccgaacataaggggaagctattgacatggtatcgaaaggttgtccacattgggaagtaacttggttctatgaatcttcatgtcagatacgtaggacagactctttcctgtgtaaatatttgtgacagctacgtctattttctactagatgtttacacagttttgtcacaggaaatctacgcttaaaatatgtatttcattcaagcggtaaccgctgtacgagcagtgacattgctggtcgcaccctaaatgtgaaccaacgttacggcacaccgtgatgtacccgcattaaagttttgtaaattcgttattacgattatcgagttggctagatagaaaaccggaaatgtaatggatgcccttttcgaatagctgagtttctttgcctaaaatagcccaatattgttgccctttttctatcacgaggttactgagccattgcatgaacgcgcgcgcctcggcggctttttttttctgctgtgctgtataaaagcgaaaagccagaagttactatctcgaataaaaaacccctcgaactgccatctcactaccgaaa

SEQ ID NO: 148 - DNA, 1000 bp, Artificial
  DIA1
actacgttaaaattgagcagccatgattaccgttttacgatgtaacgcttttttaaccttaatagatagattccctcatatatttataactatgtacccacataagtatacttttggaatgataatactaacgagataaaaaaccgttgaaaaatttctaagttttcttgaactaaaaatagccaaaattctccatccacttgttgttgcaaaatgttacgaaggcgaggttcttggaaatctggatgattatgggaaaattcgttcaacaagaacgccgagcctggacgaaatacttagtcggcatggaactagttatgaatgacttttcctatataagatctacaaccgtttccaattcaccatgagatatatatatgtttaacgaatcaggtactcgtccgaagcatttcgagtaatgcaaccccacaagtgtcccccaagaattcactgggatttttgatgaccgaaagaaagctattgcagctgctacggcgtcctttcatctccctttctttattcacggccttaagagcttgtccgcttcgccccaaaagcctaattgcttagagcatgagagttgaaaacgaccagaagtgtcgttttaggtaagcattcggccataatgaacagtaagtttgtccgaaaaatacaccgctagggttcgataacgaagagcgcatatcaattgcgttgtcgacttaattgctctcttagtacaacggtatgtgtcagtgataaaatcctaccggttccactttttgtgagcgatagatgacggaacgtatgcgcctatttcttttttttggcgcagcaaggacaatggtccctttttgagaaaatgttgtaggcttggccatcggcgtgaacgcatataaaaagaagactgccaacatgacagtatttgaaacaactacagatttggcaaagttcgccaagataaagaagaccgaagcaggtgctaagcttccattaaaagtttttcaagaaaaatctgatt

SEQ ID NO: 149 - DNA, 1000 bp, Artificial
  YNR062C
taaaactgagctattctatatatgtatgcttgagtgtagagctcgaattatataaaaaaaaaaatacattactgtgatccgccaggaaaaggcagtaaaaaaagctgatacatatttacaacggcgaatcgcgaagacacttacttttctcacatgcctttgtctttatgcttacaaaggaccactttacttattcttctagtctttcgcttcgacgtcggaatctcaaaaaaatatgggacagctgtctggaaatgggggacagtctaggtaattagaattaccaaacgcctactgttctcttctattactaaaataagttgattttactattttgatacagaagtatagcgcccaaacaagcctatcccattctaagcggaacaaaatttcctaatctggaaaagaatcgccgtcaataaataatcatcatataaaagatcagttaacattactttctagttgtcaagtactctttcgttcttcttaattgtatctcaattgcattacaaatccatccatttcactcgacggtggtacaataaattaaaatgaaaaaaatcttaggtgtcaagaaacacatgtttttgaaatacttggctgtaattttgatagctgtccaattcagtttcgactcctgtgtatatctctcaagtgtggttgactacatcaaagaagtaagtgttaatgtaaatctaagataatttcaatgaactagtatgctaacaatttagagaacggagaaaccaatccggacaaattcttgttcagaattcaagccatttctgcagcagttcaagtttttgtttcattcattattggggatattgctgcttttcttgggtccattaaatgggtaatagtggggctttactttttatcctttgtgggtaattttttgtattcatgcggcggtgcagtgtcgctaaacacccttctcggtgggcgtattatatgtggtgcagcatctgcttctggtgctatagtgttcagttacatc

SEQ ID NO: 150 - DNA, 1000 bp, Artificial
  PRE10
aaaacattgacagctcagacgatagaaaaacatgtgatacgaatcatttcgccgttgtgtgttttaagaagaaaaatgttaatgttagcaagacgaaatcacacgtataaataaatatagcagcacgaccagcttggaagttcaaaaaaaaaaaaaaagtgaagatagacaatcataggcacaatttctgatggtagtgaacatataatgggcagaccaagctctagcaacttaatgcagagaaagatttgaagctaccgccgcgtgttcagcgtgactctctataataggccatttatgtacaagatcttctgcaatcctatcaagtattcgtactactattttccctgccaattagacgtgatgaaaaatattgctgggctttggtttgaaaacgactatttaaataaatattacctttccttttcttcaattgtttctcatctccttcggcctccgttaagtatatgtttttttacgcgttgtcaatgacaataccgcaggatgcgaatgtgtgacttcgtaatcatcggtgtgaaaaatactctaactttaaacaaaggtaacatctaaactgtctggaaatatgcagctattcccatgtatacacactagaaagaacagtatttcccaggtcccagaagttctctgtatatgtagtcctacccgtaatttaccctttgaagagataatctgagcactcagatttcgaccctgatggggtcacttttctgaatcattgctgacattgcttctgaaaagtgttgcctgtgtctttattccacttatgagttggtaagcttcctcacaatttataatgggttccgatagctaaatcacgtttaacgaagatttcgccgcccctctaaatcggtggcaaaaataagaaagtaagtggtaatagtggcggtagagggtttatttggtagtgcagttgtaaagctttcaaacacattcgagcgtcgcatcatcaaattaacaaaagcataactcttcagca

SEQ ID NO: 151 - DNA, 1000 bp, Artificial
  AIM45
gggaaacatatcagtatcgtgaatccatcctcaaaaatatatcattcatcccataaacagattgttaaaacgcctatccctaagagtggcctttctccaattgagagatgccctttcaatggtcaaaatattaaatgctactcaccaagaccactagatcatgaaagtccccaacgtgatttcaataataactttcagctgagaatactgaagagctcggtgttgcaaaggagacaatcaacacagaatagttgaaaaattcgttggtactagcttcgggtcggttagctgcgctgctatgcatttgttaatatctccatcgaatttttgttgtttcgttcaataactttattacttcccccttggactctttcgttctatcgttctacaagtccagccaaaatttttcccctcttccttttcttttgttcacttcttagctcacttatataattatatactgatatttggattcttttgttgcaaatatgctctcccagatttttctgttgagatgattcatgctttacatggattgagcattagagagtaactatatccaatttcgtaagacgagtatctactttcccttgtccccagtaacctcaggaacgtgacaactacttttcttaaactgtcaacagccaatgataccgtattcaatgcatgtcttgggattaagccactttgattgagttccgtattagtagtgagaattaaatcttgcaagatataagaattactcaacagagacgagatactttcctttttttggttcttttgttgttacttggcttaatggacaaagtctgctcgcatattgtatatgttactcttacgatgtgactccgcccgtttattatgacttttcggtacatttttagggcctcgaacgaaaatctactaactaaaaattaaaaacaattaaaataatcaacaaacaaaatctagtgatataatttactaccattaacggtaaagcagctaattgttaatttct

SEQ ID NO: 152 - DNA, 1000 bp, Artificial
  ZRT1
agacttgagatagatgtacctggagagaaaatctataataaaaaaaaaaatactttcaggtcagatatttctttttttgtccctaataaaaagaaatggtattctgccaaacaccaaagtgccaaataagcattattttacatagtacgaaatggaaattacgtcaattatcgacattatgacataaaattggatttaacaagatctctgaatctgatatgcttctttcattagggtggaaataacagcatttgagagaagcaattgccaagcttctatgaaaattttctagaaggcaagagtatttcagactttcctaatatgaaaggacaaattgacactaatgtctgattatggccaattcctgcggtaaattacacggcgattacggcgacatgagctcacattcatcactctatgggacaaatgtttccaaactgggcgcaacaaacacctgatgtgactcctaccctttggacaatgcagatccacgctacggcaaattagtcaaatgcactagaacatggcgcaagtacttattgtgacctttggggtaccgttaccgtcagttttcttcagctaaggcgcgcgcgccagataactaaaaaaaaatatagttgctgcttaaaaaacaatacacccgtactctcttgcctgtaaaaacctcgaaggaccaaagataccctcaaggttctcatctgtgcggtattcttcaaattacaatgacatttcccaaaattatcagatgtgctcaggtatcttctctccaatgagatgagacagatgaacatatttgaccttgaaggtcatggaaagtaggttgagagcaaatgtgtagaacgaaattaagaaaaaaagaaattacgcacggcattagctcgatgacttagttataaatagaggcctggtatcggctgtcatgatctcatctcttccctatttacaaaaaaactgcaagtatagacaataaaacaacagcacaaatatcaaaaaaggaatt

SEQ ID NO: 153 - DNA, 1000 bp, Artificial
  ZRT2
tccgggtaccattgaccagtacgtcaaggaactacccgacaaactattcgagtgcttataccctaactgtaacaaagtattcaagcgtagatacaacataaggtcgcatattcagacacatttgcaagatagaccgtattcatgcgactttcccggttgcaccaaggcgtttgttcgcaatcatgatttaataagacacaaaatctcccataatgccaagaaatacatctgcccatgcggaaagagatttaatagggaggatgctctaatggtgcatagaagtcggatgatttgcaccggcggtaagaaattagaacattcgatcaacaagaaacttacatctcccaaaaaaagcctgcttgacagcccgcatgacacaagtcccgtaaaagaaactatcgcccgggataaagatgggagcgtcctaatgaaaatggaggaacagctgcgagatgatatgcgcaaacatggattactggatccacccccatccacagcagcgcacgagcaaaactcgaaccgcaccctttcaaacgaaactgatgctctctgacgaacatttatctatgcatgatattaacataataaataatagtaacaataatataatacatttatttctttacgatttacgtacactgtagtcttaagggccaaaaaaggcaatagtcatcgtttatagggacataaccctaaaggttatatgcgactccttctcgaaaatgaaaatttttcacaacctttagggtacattgccctttaactactacaaaccagcttcacacatcctttggtaaaacacagtgtgacgattttaaatgacgcaaccttttgggagacacgatctaaaacccactatatatgatgatactgtttattgaatcatacaccctgttggttagaccggaagaaagctaaagttgatctccgaaaatacaacggtgcatcaaccaaagaaaacattgcaggcgtttccaagtgacactgcatattcgaaagt

SEQ ID NO: 154 - DNA, 1000 bp, Artificial
  PHO84
tcacttcgtttttttaccgtttagtagacagaatgcgagagtgataaagaagaggcggttaatcaatgaaaaaaaaaaaaaaaaatttaaaaaagaaaagagaaaaggaataaaaaagtgtcacgtgataaaaatcactacccggagatgacttcaaacgactcggtatactctgcctaataaaccttaattttcttacaaaaaaaaaagattcaataaaaaaagaaatgagatcaaaaaaaaaaaaaattaaaaaaaaaaagaaactaatttatcagccgctcgtttatcaaccgttattaccaaattatgaataaaaaaaccatattattatgaaaagacacaaccggaaggggagatcacagaccttgaccaagaaaacatgccaagaaatgacagcaatcagtattacgcacgttggtgctgttataggcgccctatacgtgcagcatttgctcgtaagggccctttcaactcatctagcggctatgaagaaaatgttgcccggctgaaaaacacccgttcctctcactgccgcaccgcccgatgccaatttaatagttccacgtggacgtgttatttccagcacgtggggcggaaattagcgacggcaattgattatggttcgccgcagtccatcgaaatcagtgagatcggtgcagttatgcaccaaatgtcgtgtgaaaggctttccttatccctcttctcccgttttgcctgcttattagctagattaaaaacgtgcgtattactcattaattaaccgacctcatctatgagctaattattattcctttttggcagcatgatgcaaccacattgcacaccggtaatgccaacttagatccacttactattgtggctcgtatacgtatatatataagctcatcctcatctcttgtataaagtaaagttctaagttcacttctaaattttatctttcctcatctcgtagatcaccagggcacacaacaaacaaaactccacgaatacaatccaa

SEQ ID NO: 155 - DNA, 1000 bp, Artificial
  PCL1
tcagtgacgacgttatctatgaatgctgtggggcacccagaccaagtgacttaaaggcagtattgaagtcgatactggaggacgattggggtaccgcccactacacacttaataaggtacgcagtgccaagggtctcgcgttgatcgacctaatcgagggcatagtgaagatactggaagactacgaacttcaaaatgaggaaacaagagtgcatttgcttaccaaactggccgatatagagtactcgatatccaagggtggcaacgaccagattcagggcagcgcggtcattggcgccatcaaggccagcttcgagaacgaaactgttaaagccaacgtataatcgacgcaaatatgtatagatacaatatgtacagaacaactgcattgtgcaatataacaacataacacaacgcccagaacgaaataaaaaaaataaaagaaatagatgaaagcattttcaatttgcataccggaaaccgtaaatcaattggcgtctagctaacaactgagaatgcgaatcgccaaattgttacagaaagtagcattccgttacgtgatctgtactttaacctcttggacgtaaagaatggcagaactctggctctagtgttctgcgaatgccagatcgggaaatatttcccaaaagggcaacagcggcacgaacaagaatttcgtgttaaaaatcgcgtccggcgcgaaatttttcgcggaggcatgcgacgcaaaagcgactcgaaatgtcgggagccaaatgaggctacaaggctgtgggcagattttggcgttattatggagaataaaaggaatggtagcttccatatagcgataggaaaacatatataaggtcaataggcctacatggtaatgggattgataagcttgtccttaactcttgtgtcttggaattactattgcgtacatcagcaatcatccattgtcaagaacaaaaacgataacaaaaacaatcaattatacaaataacagtaaagtaataaa

SEQ ID NO: 156 - DNA, 1000 bp, Artificial
  ARG1
aggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatagacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttggcccgtttttttccgctgtcgcaacctatttccattaacggtgccgtatggaagagtcatttaaaggcaggagagagagattactcatcttcattggatcagattgatgactgcgtacggcagatagtgtaatctgagcagttgcgagacccagactggcactgtctcaatagtatattaatgggcatacattcgtactcccttgttcttgcccacagttctctctctctttacttcttgtatcttgtctccccattgtgcagcgataaggaacattgttctaatatacacggatacaaaagaaatacacataattgcataaaata

SEQ ID NO: 157 - DNA, 1000 bp, Artificial
  ZPS1
cttcttgctagtatatatgacatactggtgcaaatatggcataacatcaagaggcagtcatcatatctaaaggatacagaaatggaaggattgataatgtaacaaggtaatgaacgacaatatgtaaaatgaatgaaagcctcaataatatcatacagacaaaaatcgattcccttttgtgaatttttttttttgtatcctccaggagaaattcatacctaatgagaacagtggaatcccaacacaattatctaattttttcatctatttctcatagataaaatgaaatttcaataattgaccaatattcacctggcccataatcaatcgctgtaataaaatctccaaaaagggtaaaactaaacaacttttaaaatgtgaaaaattaagtaaagaaaaagataagaataaagtccaacaagagtcaactgcttgaaattttcagctgaagtggaaaagaggtgctgatcattgagtgccaaacggaagtttgttgctgccgcaatgtcaatgaagcattaagctctgacgttttgccgtttctttttgggcagtatgcgatcaatttatgctagccaaaagaaaaaaatcgtatgcgcgctgaatcagccgtagctagctgtcgacaatgacatggcggaagcgctgtttttaaaggcttcttataattgaccttcagggttaggaccctgaaggttttttgtagccatactgcttacaagaatgtaacctctttggaggaaaaagaaattatactttcttttccagatcacgaatctgttgaagtactgttcttttccgtggcttgaaccctctacaagagatctatagacgccgcacatgctttcaaatagagctacattctggtccttcaatatatcaattagaaacgtataaaaacaagacaaaattactgtcattgggggagaacaacccatctaggaattgggattgagcaattaagatagaaaaccaaatccacacacaactactaaacatt

SEQ ID NO: 158 - DNA, 1000 bp, Artificial
  FIT2
acgcaagacaacaggcaaaataatttcgtttctcagtaccgaaatgacgaaatatactgaggcaaatgcgatcatcatgcctttgcgccaagaaactcccttgtgaagaacttcaaaccgaaatgggaaaactttgagttattgacagggaatacggaggggaagatcacacttaaatccgtatgagccgcgcacataatggtattcaaatacacaagaacattcatgagctatttttcatccgtgcaaacgaatttactacaattggaccagagggcaccataactggagactttgctactgactcaacgttgatgatgcgagtagtgggtgtactgtgatttgctcatttttttttttatagaaagattcgattaatgaaagtcacaggagacatttttacatagacattccgtatatgttgcgggtatcgcggatgcggattagtgatgcctttaactacatttcatagatttctgtataccaattgaaatgagtgaagtaagctcctacagtgaaatatctgggtgctactgacgccaagccctacagcgatcggaatgcgggaacggaagttaacggggcttccagaacggcggaagcgaattgaacgaggacggcaaacaaaaacacccaaaatttcattacttagaatgaccctcaagagcagggtgcaatttatcaagcgatcattgaactaactaagttcatatcctgtataggatttaaaacaatgcaccctaagttcaaatgcaccccccctcgccccgcagcggacccttgaacagagaactgtttcgaggttcacccaattggatcacttgtataatttgtaatcgagttcggataagatgtatacgaatctaactgggtgcagtataattagcattttatattacctagcaatatatgtataaaacaggaatgtgtgcgtgcttcaggcagaattttacggtccttgtaaaaaagtctatcataaagccatcacaaaacaataata

SEQ ID NO: 159 - DNA, 1000 bp, Artificial
  FIT3
tccataaacatttcctttgtctatattatccaggggcccaaaataagcccatacccacctatctagagaggctttattgggagtgacgggatatcgtatgttttcctttacctcatcaagaggccggatgaaaagggatgcattggcaaaaattcgataatactcctcattgctgacgacctcatctttgtgataatcgtggcaatactgattaattttgctaaacgttttttcgaatatttttttacttttcttcctactgtcgagaacatccttcgcgcaatgtaaccaagaccctagtgctggttcataagtgcaaagagtagcgtgccgacccttcacatccgtgtcaaatttgtgtgattccaattctttagcacaagcatcaattgctatctggtcccattgcgttcttttcttagttgatgctggttttgctaaagaacctggtgccaaatacaccaacagcagcactaatctagcgaaaagcattcgaaatctgggtgaattaaattaactgcgacaaaattggtgatgtgacataccgaaaacgctacattacacatttgccaagtaaaaaattgacgctccttttttaatgatcgctaatgtaatgaaaagtaaaaatccaattaaacgaggaagcggtaaaatatgattgctgtgtagtaatgccacagtcttcttagtcctacctatgtcctagatttttttttgcaccctgtttgttccgcaccccgctatcccatattttttgatgtatgtgaaggaaagcaatctaagggctcaagagccgagttccgccattctaggaaagggtgcaaaaaaatggggttcaattatcgttcgagatttgttatttttttttttgtaaaagttgatttatggggtatttaagccaagaactatttgaagtattaggaggtaatatgaatgttcgaacagatacaaacaagtacttccactcgcttaaaaataactaataacaataatccctaaa

SEQ ID NO: 160 - DNA, 1000 bp, Artificial
  FRE5
ttcagcagtggtggttgcagtggttgaagcagaagaggtagcagcttctgagctggtagaagtactacttggagaccaggtgttgctgctgccttcaccagtccagacaaaagtagcatcttgggtgacagtcttagtgtagacgtgaccgttcttggtggcagtgatagtggtagtgatactagaaccagaaccttcatcagcagaagaagtctcagcagcagaagaagtctcagcagcagaagtggtagcggcagcagaagtggtagcggcagcagaggtttcggcggcagaagtttcggcggcagaagattcagcggcagaagtgctgctggcgtaagagtcttcaccaccccaaacaaaagtagcatcttgggtgacagtcttagtgtagacatgaccgttcttggtggcagtgatggtggtggtgatactctcagcaagagcagtagcggcaacagcagatagaaccaaagcggaagagaatttcattttagggattattgttattagttatttttaagcgagtggaagtacttgtttgtatctgttcgaacattcatattacctcctaatacttcaaatagttcttggcttaaataccccataaatcaacttttacaaaaaaaaaaataacaaatctcgaacgataattgaaccccatttttttgcaccctttcctagaatggcggaactcggctcttgagcccttagattgctttccttcacatacatcaaaaaatatgggatagcggggtgcggaacaaacagggtgcaaaaaaaaatctaggacataggtaggactaagaagactgtggcattactacacagcaatcatattttaccgcttcctcgtttaattggatttttacttttcattacattagcgatcattaaaaaaggagcgtcaattttttacttggcaaatgtgtaatgtagcgttttcggtatgtcacatcaccaattttgtcgcagttaatttaattcacccagatttcga

SEQ ID NO: 161 - DNA, 1000 bp, Artificial
  CSM4
acctgcccagacatttaatatagataggtggctttgatgagaggaagttgaaggatccttcaaaagcaagtgattgtttacgtttccgttcaagtcgcagtttagctttaacaactttccattctgaaatccaactaaaatttgaatggtgtttgaattataaccaaaattgcagtccatacatattattgcgtccgatagcagtaaattcaactgcccgtaaaattgctgcttaataaaaatcaaatgttggccgttaaagtcatacagcagtaattttttgtcctctgcttgattagaataaaaaatccagtacttgctattgaaatttctaaaacttttgaaactttgtaaatcgtgggtagtaaaatagttattaatccgtacaaattccaacccacggttacttcgaaaaacatcttcaagttccttttcttcgtcaccatcatcgtcttcttcagaatagtttccaacatctccaccatcctctccgacattgctaaaggtaagctggtcgatatgttcctttatcgtatctggaagctgtgggtaatcattattcaccgtgtagttgccatacttgctcgcccgttcgtcaaatacgttctgatatctcgtgtggtaaaattgcacccccttcccatcctggtatatttgcataggtatacccatgatttcgttatgattattttctttcttgagggtgtttagcaatacattattatccttgtgatttcgcttatacacatgtaggatttcctccttatatattacaagtgtgtcaccatttccggcccaccaatagccgccgacctccaaattaccccaaataaaaaaaaagaaaactccggaaatgcggggttgagctgcaatataataataatatggcaactttagccgcgcaatcgaagatacagtaaatatagtaaaaacgtgtctgcaaatggctactttcgatccttcttcccaaaaggcaatattgcagaagaagaactagaaa

SEQ ID NO: 162 - DNA, 1000 bp, Artificial
  SAM3
ttgagtttggggagaaaaggctgcttttgttccatagtgcgtcttttaaaaattttcatccttgttattatcaaactttttcctgggcggtaacctagctgaataagaacgatttggctgcaatcgccgagaaaacaaccaagccaagaattcccaaaagggatatgcttgcatccgcattgttccctcggttctactaataagaaagagtaagagacaatgtttagcgctattaagttatgctatggttacatcattttggcggactggatcatgtctgtcgagaaaaacttgaccgataattcaacgaagtattggtgcctaagctttgcatcataatatcttacaagttttgctgagaacagatagaggcataaatgaatgatttacgtcttattttttgataaggaggtatcgacgtctgccagcttaagaatatgaaatctggcgcatgatttcttcaaaataactcagatattgtcaagaacagcccactattgcttggaagtgaaaatatacgccaaaagtgcattttactttctacaattcaccacagtcttcgagatatatttatcatttaaatcacatggacacccaccgaactggttacaagctatattcgcatcacacagaatgatgtggcgtctatgctatacggcgatgttactatatcattaacctctcttttcggttccgagcgctttcggctcaagaactggggatgactaaaaaaaaagaactgtgtacgtgatttctttgtcccctgcggttgcatagacatcgctgtcgcacggcaagagcgcacacagtcatcagtctacaaaacctaacttttcaagagcaaccagtataaatattttgagccattgagggcataaagcgaaaggcacattttcaaaattggtcttaggttcatcttctgatgttatgtcgagagctctgaaaaccaattattttgaaagctaacatttcaaaaggctatttcttctgaaatatcaag

SEQ ID NO: 163 - DNA, 1000 bp, Artificial
  FDH2
tgtcctcctaatatcttttatctttaatactgtaggggcgcaagtttctttttttttttttttttatgttgcgtttagtttttctcttggcaaaagtttttcgcaccccgatctttttttgcatacgtagttcactgccgctgcttacggcagcgtttcactttgtttggagaacggttgttaacttgtatttgatatggtgtcgagacaatgtcattgcaagttatataaacattgtaatacatcacctcgatgaaagagaaactggaatgatagatctctttttctcaaaatttcgttaatatgtaataataaggttcctgatgtaatttgtttttgtacaaattattttagattctggaggttcaaataaaatatatattacagccaacgattaggggggacaagacttgattacacatttttcgttggtaacttgactcttttatgaaaagaaaacattaagttgaaggtgcacgcttgaggcgctcctttttcatggtgcttagcagcagatgaaagtgtcagaagttacctattttgtcaccatttgagaataagcttgaaagaaagttgtaaccccaacttttctatcttgcacttgtttggaccaacagccaaacggcttatcccttttcttttcccttataatcgggaatttccttactaggaaggcaccgatactataactccgaatgaaaaagacatgccagtaataaaaataattgatgttatgcggaatatactattcttggattattcactgttaactaaaagttggagaaatcactctgcactgtcaatcattgaaaaaaagaacatataaaagggcacaaaatcgagtcttttttaatgagttcttgctgaggaaaatttagttaatatatcatttacataaaacatgcatattattgtgttgtactttctttattcattttaagcaggaataattacaagtattgcaacgctaatcaaatcgaaataacagctgaaaattaat

SEQ ID NO: 164 - DNA, 1647 bp, Listeria grayi
atgtacaccgtcggccaatacttagtagaccgcttagaagagatcggcatcgataaggtttttggtgtcccgggtgactacaacctgacctttttggactacatccagaaccacgaaggtctgagctggcaaggtaatacgaatgaactgaatgccgcgtacgcagctgatggctatgctcgtgaacgcggtgttagcgctttggtcacgaccttcggcgttggtgagctgtccgcaatcaatggcaccgcaggtagcttcgcggagcaagttccggtgattcatatcgtgggcagcccgaccatgaatgttcagagcaacaagaaactggttcatcacagcctgggtatgggcaactttcacaacttcagcgagatggcgaaagaagtcaccgccgcaaccacgatgctgacggaagagaatgcggcgtcggagattgatcgtgttctggaaaccgccctgctggagaaacgcccagtgtacatcaatctgccgatcgacattgctcacaaggcgatcgtcaagccggcgaaagccctgcaaaccgagaagagctctggcgagcgtgaggcacaactggcggagatcattctgagccatctggagaaggctgcacagccgattgtgattgcgggtcacgagatcgcgcgcttccagatccgtgagcgtttcgagaattggattaatcaaacgaaactgccggtgaccaatctggcctacggcaagggtagcttcaacgaagaaaacgagcatttcattggtacctattatcctgcatttagcgataagaacgtgctggactacgtggataactccgactttgtcctgcactttggtggtaaaatcattgataacagcacctccagcttctcccaaggcttcaaaaccgagaacaccctgactgcggcgaacgatatcattatgctgccggacggtagcacgtattctggtattagcctgaatggcctgctggccgagctggaaaaactgaatttcacgtttgccgacaccgcagcaaagcaggcggagttggcggtgtttgagccgcaggctgaaaccccgttgaaacaggaccgttttcaccaggcggtgatgaattttctgcaagctgacgatgtcctggttacggaacagggcacctcttcttttggcttgatgctggcgcctctgaaaaagggtatgaacttgatctcgcaaacgctgtggggtagcattggttacacgttgccggcgatgattggtagccaaattgcggcaccggagcgtcgtcatatcctgagcattggtgatggtagctttcagctgactgcgcaggaaatgagcaccattttccgtgagaaactgaccccagtcatcttcatcattaacaatgatggctataccgttgagcgtgcgatccatggcgaagatgaaagctataacgacattccgacgtggaacttgcaactggtggcggaaaccttcggtggtgacgccgaaaccgtcgacactcacaatgtgttcacggagactgatttcgccaacaccctggcggcaattgacgcgacgccgcagaaagcacacgttgtggaagttcacatggaacaaatggatatgccggagagcctgcgccagatcggtctggcactgtccaagcagaatagctaa

SEQ ID NO: 165 - DNA, 1641 bp, Macrococcus caseolyticus
atgaaacaacgtatcgggcaatacttgatcgatgccctacacgttaatggtgtcgataagatctttggagtcccaggtgatttcactttagcctttttggacgatatcataagacatgacaacgtggaatgggtgggaaatactaatgagttgaacgccgcttacgccgctgatggttacgctagagttaatggattagccgctgtatctaccacttttggggttggcgagttatctgctgtgaatggtattgctggaagttacgcagagcgtgttcctgtaatcaaaatctcaggcggtccttcatcagttgctcaacaagagggtagatatgtccaccattcattgggtgaaggaatctttgattcatattcaaagatgtacgctcacataaccgcaacaactacaatcttatccgttgacaacgcagtcgacgaaattgatagagttattcattgtgctttgaaggaaaagaggccagtgcatattcatttgcctattgacgtagccttaactgagattgaaatccctcatgcaccaaaagtttacacacacgaatcccagaacgtcgatgcttacattcaagctgttgagaaaaagttaatgtctgcaaaacaaccagtaatcatagcaggtcatgaaatcaattcattcaagttgcacgaacaactggaacagtttgtcaatcagacaaacatccctgttgcacaactttccttgggtaagtctgctttcaatgaagagaatgaacattaccttggtatctacgatggcaaaatcgcaaaggaaaatgtgagagagtacgtcgacaatgctgatgtcatattgaacataggtgccaaactgactgattctgctacagctggattttcctacaagttcgatacaaacaacataatctacattaaccataatgacttcaaagctgaagatgtgatttctgataatgtttcactgattgatcttgtgaatggcctgaattctattgactatagaaatgaaacacactacccatcttatcaaagatctgatatgaaatacgaattgaatgacgcaccacttacacaatctaactatttcaaaatgatgaacgcttttctagaaaaagatgacatcctactagctgaacaaggtacatcctttttcggcgcatatgacttatccctatacaagggaaatcagtttatcggtcagcctttatgggggtcaatagggtatacttttccatctttactaggaagtcaactagcagacatgcataggagaaacattttgcttataggcgatggtagtttacaacttactgttcaagccctaagtacaatgattagaaaggatatcaaaccaatcattttcgttatcaataacgacggttacaccgtcgaaagacttatccacggcatggaagagccatacaatgatatccaaatgtggaactacaagcaattgccagaagtatttggtggaaaagatactgtaaaagttcatgatgctaaaacctccaacgaactgaaaactgtaatggattctgttaaagcagacaaagatcacatgcatttcattgaagtgcatatggcagtagaggacgccccaaagaagttgattgatatagctaaagcctttagtgatgctaacaagtaa

SEQ ID NO: 166 - protein, 343 aa, Anaerostipes caccae
MEECKMAKIYYQEDCNLSLLDGKTIAVIGYGSQGHAHALNAKESGCNVIIGLYEGAKDWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 167 - protein, 343 aa, Anaerostipes caccae
MEECKMAKIYYQEDCNLSLLDGKTIAVIGYGSQGHAHALNAKESGCNVIIGLYEGAKEWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 168 - DNA, 2045 bp, Saccharomyces cerevisiae
taatctcttgtagtgtaggatcaactattttcgcatacttgcaatgttcagcattgcaccatttcaaattttaatattaatattaatcgttttcgttcatatgttcattcatagtttacaaataatgcaatcatatgcagagatattttgtccgtggttaatagggctgcctgttattcctttaattcaactaaattacatacgtctaataatatcaaaaattttgacgtttttgttttttttctttattttaagtaagaccaaaccaggggagaaagggttgctacgcctaacaacaagaacttgtatatcgtttcttgttacttatacttttctgcccacttctctcttagaattgctcgagctcatccttggtaataaaacagtgaggacggttactcgaggtttcaacaggggaaaataaatttatatgatgaatcaagagccccgttcttttaccgtattctctttcatactacatactagggaaagaactgaaaactccgctacctgctgtaacagcgcataataaaaagcaagaatatagacagttactgttgtttacgttctttgatgacatcattctcatcagacatacagaaacacatcctttttgtctaccccgtatttattccaacttcaaagtataggtaccgtccggttatactctcatatactttgtggcagttcgcttctttaaaccttgttaacccagaatattttcagtgcaaaaagcttccgatcctcaaatacagtgagaaaaaaagcaaacttgtcttcattatttttctgtttggccctgtcacggttctttttatggccttctcgaaggatatccgtagtcgattatattcacgtagttgccaaaagtaatttttggaaaaactattattcctccgagaaaacctcacacagaaatccttgcaggtcccatctggaatataattcccccctcctgaagcaaaatttttcctttgagccggaatttttgatattccgagttctttttttccattcgcggaggttattccattcctaaacgagtggccacaatgaaacttcaattcatatcgaccgactatttttctccgaaccaaaaaaatagcagggcgagattggtgctgcggaaaaaagaggaaaaatttttttcgtagttttcttgtgcaaattagggtgtaaggtttttagggcttattggcaagcagaagagacgacaattataggtcttaaattcaaggcggatgtaaggagtattggtttcgaaagtttttccgaagcggcatggcagggactgcttgcgcatgcgctcggattatcttcatttttgattgcaaaaacgtagaatcatggtaaattacatgaagaattctcttttttttttttttttttttttttttacctctaaagagtgttgaccaactgaaaaaacccttcttcaagagagttaaactaagactaaccatcataacttccaaggaattaatcgatatcttgcactcctgatttttcttcaaagagacagcgcaaaggattatgacactgttgcattgagtcaaaagtttttccgaagtgacccagtgctcttttttttttttccgtgaaggactgacaaatatgcgcacaagatccaatacgtaatggaaattcggaaaaactaggaagaaatgctgcagggcattgccgtgccgatcttttgtctttcagatatatgagaaaaagaatattcatcaagtgctgatagaagaataccactcatatgacgtgggcagaagacagcaaacgtaaacatgagctgctgcgacatttgatggcttttatccgacaagccaggaaactccaccattatctaatgtagcaaaatatttcttaacacccgaagttgcgtgtccccctcacgtttttaatcatttgaattagtatattgaaattatatataaaggcaacaatgtccccataatcaattccatctggggtctcatgttctttccccaccttaaaatctataaagatatcataatcgtcaactagttgatatacgtaaaatc

SEQ ID NO: 169 - DNA, 1350 bp, Saccharomyces cerevisiae
agacagggttactactaactacaaccctcatactgccttacgtagccaaacaagagcagttctcagattacaatgggagatcatttgaaaatatcaaagattgatcaagaatattttactggtggcatccgcccgccctttaatttcggaatttagtgctgcttacaactcttcattttcctcatgcgggacgccagctttggtgcgggatgaaggcaatatccaaaccagcatcaggaaaagcctgaagaaatgtggtgcctaatgctcttatctaatctgtatccacaccttacagcgaagtgttcaattaactgtgcggctaattctgacacttcatcaaaaattacaccggtatatcaaatggcggtgtagtttgaaaagtacactgtatgtccattaataaaattacgccgaagaacactgactagctataaattctcttccggcgtccaatttcaacctaaggcaagtattgttaatcaataatgcgtgttggtaaatatgaagcccgatgttgattaagaagaattattcgtataagaattaagcaagcaaaattaaggaaaattttttctttcctattcgtcatcgcagacagccttcatcttctcgagataacacctggaggaggagcaatgaaatgaaaggaaaaaaaaatactttctttttcttgaaaaaagaaaaaaattgtaagatgagctattcgcggaacattctagctcgtttgcatcttcttgcatttggtaggttttcaatagttcggtaatattaacggatacctactattatcccctagtaggctcttttcacggagaaattcgggagtgttttttttccgtgcgcattttcttagctatattcttccagcttcgcctgctgcccggtcatcgttcctgtcacgtagtttttccggattcgtccggctcatataataccgcaataaacacggaatatctcgttccgcggattcggttaaactctcggtcgcggattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatc

SEQ ID NO: 170 - DNA, 902 bp, Saccharomyces cerevisiae
tttatgctgcaaaggtcctaatgtataaggaaagaatatttagagaaaagaagaaaacaagagttttatatacatacagagcacatgcatgccatatgatcatgtgtcgtcgcacacatatatatatgcctgtatgtgtcagcactaaagttgcctggccatccacgctatatatacacgcctggcggatctgctcgaggattgcctacgcgtgggcttgatccaccaaccaacgctcgccaaatgaactggcgctttggtcttctgccatcgtccgtaaaccccggccaaagagaccggaaagatcggtgaaaacatcttgatcttgctcccgggaattttagattcaggtaggaaattgattacatcaatactgttaccctgaatcatattcgacgatgtcgtctcacacggaaatataattcatttcttggttttccaaaaaaattttcattttttttcacttttttgtttcgtcctcctttttttttttttttttttattttttttcctgtgttcacctttttttttttcagttgacatctttctgcattcttttctgtgtttttttttttttttttcgtttttccattgttcgttcgttgcctgttttttcgccctattgttctcgagcctaaaaattttttcctttcctgctttcctttcttcgttcaaagtttcctattccattgttctctttggtaaactcattgttgtcggaactcagatatattcaggtcaatttactgtacttcaattgacttttttcttgaaatttcaacttgccttttcaacttgttcttcttttttaatcttattctacactttagttcccttaccttgttcctaattattgtctagcaaaaagaaaacatacacctatttcattcacacactaaaac

SEQ ID NO: 171 - DNA, 1000 bp, Saccharomyces cerevisiae
acaatctttgagcatgtttatggatgcacttaggggtcctacaagccttcgtatgaagttgcccctcgcaagcacactataaattcatgaacaattgcgcagtcaaagttagattgtaagccgaattcaaacgatttcaacagtcgtagctaacgaggccttttgtctcacacccttacaaagggactgtagaatgcaagggcaaacaggcctgaggtaactttaaaatataatgtaccttgaaaactatgtatacattgcatttattaagcagtagggtattttgtttgcaagaaaataaagctcaaaatatctttggagtttgacaatagtatagaaaaaatagctcagcaaccttaataaaaaaagggtcattgggcaaagcgttttaaaaagatttaagtggtagtgtttaaagtgaaagagattgatatagttaaaaattgttgagctcaattcacgctggattcggcgatccgttttcttcaatcctcacgtgctttcttcgtttgagtgcaaaagttcatatgatgctatctcccgcttatcttattagtcgaaaatggggagaatttcctattttatctgtcgtttagcacatatggccaggaaaatacataaggtttcgccgaacgacggggtcaattcgtcctttttgtacacatcgtttaatttatgaggaaaaattgatgaatgtatcctccgtagacgctcctctgaaaagtttcatgtttcctgcgcgttcctttgataggcaataaaacaatacaacgcgtgcctttgaaaatgccaagatctatacgaggcctctaacaaaacatcgttcaggaacagagaatgctagaaatgcaaaagggtccctgggtactcattgaatagaaatgattgaaaatactgcgtataaaatagcacgactaaatgatactatttttatgtcgacacggtactatttcttctttttcagataaaagtgtagcatactaaatatataccccaagta

SEQ ID NO: 172 - DNA, 1000 bp, Saccharomyces cerevisiae
aaacttaaaacaatccattacctgcctagtataatttttttagaccagaatatgactccataaaacgtgaagcagcagctagaaaaacgacgcctcggcggagtttgcgtttaactctcatgtgcggccaaacaggtgcgtaagagctgtgactatttaattatgtaatatttacggaaaaaggagtggacaaaaaaggcgtgaattttactccactggcggtagccgcctataaagaaattgataagaggcgtgcctcttatgcgatcttcggaccaacaacaaagcacacaatagcgcaaagtatacacaatagagagcctgtaggaaagcagtggggaatgtcttggctttttttatgcccagaaaaaaataaacgtaacgttggggaactacgcgcaatcatatttcatggcctccccacggtgcttagagcagcgcgttgcctacagaaacatctttataaaatcttggccggccaagattcccaaacgagactcacatttcccaaaaaagacatttctgtccaaaagtagaaggcaagaaaaccctggaggaatcataggcaaagaaagaaaagaagaagttcatctttaaaactacctttcaagcctttattcgttcctcgtaaaggacacacgaaaaaaataaacagtaccttgcagaaggagtgcagagttaggtcgcagggaatccttgaaagccaagagttttttttccgtaatgatctcccaaagcaaccatcaacattgtggtgcaaagtttagtgtaagatgttctactgaactatcttaatagctgagcatcatgtgagtaaacgagtaagcaagaaaacaacaaagtaatgttcaactttcgtaactacggaaaataatatataagtagttaacgaaattcgaacaatgagagctctcacatatcatcttcttttccagtttagccattatcagcacaataatacaaaacacactcgtacactcgcttcaactataacaaaaaa

SEQ ID NO: 173 - DNA, 461 bp, Saccharomyces cerevisiae
aaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 174 - DNA, 731 bp, Saccharomyces cerevisiae
acgccatagaagagcaatttccgtcctctactcatgtgattcgaactatgaaacaaagaaaaggcaagagtaaatagcgtgatacctattacgtattacgtatacatcctattattcttgaaaaaaagtgcggggctccagagctccacattggtgaccccagagtatactgctctttctaatgccttttccatcatgttactacgagttttctgaacctcctcgcacattggtacctagaaatggctatcatgccggacggcaccgggcaataaaccggacggcacaaaaaaatcgaagaaaagagatttctttttctcgcgggcagtttttccggtcgatcgacattcgtacggtactttctctgtttcagggacatcatgttgtaaaagaaaaagacagtttaggtaatcgttcttttctttctgaaaaattttccacgacgacgacgacgaccacgaaacacctttgattgcgagatccacgaaattacctcctgctgaggcgagcttgcaaatatcgtgtccaattccgtgatgtctctttgttgcaccttcgccactgtcttatctacaaaactataaaaaagagtaatcctaccccatatctaaaaaaaattccttaacttttataacttaacttcaaagtttcttaatattttttcgctttttctttgaaaaggttgtaggaatataattctccacacataataagtacgctaattaaataaa

SEQ ID NO: 175 - DNA, 1200 bp, Saccharomyces cerevisiae
ctggagacatagactacgaaaatcttttagtcaaatttacaagggcgagtagcttttaattgtgccttcatgtgccaagtaaattgcgtacaaaaagtgtcaagagattttctcattccctacatttgccagttctataggcaccttcttgcgcatatacatatctacaaatatcccggcttatttccagtattactatgttttactcttaattcaaataagcactgctattattacttttgatcacgtcaaaagatacaaaagacaatctacaagtttatggccttgcattgtttataatttatgtgctatctgagcatacccgccttttctctattgttattcgagagaagactaaaaatatctgctgcaagaacaaaaatgggaactgcttgtctcttaaaattatcaatccacaatggaaatagactttttttacacagcaacggtttttgaatgctatgaaacggtcattatcagctaacacgctcaacactttactccatcttcttaaagggtgtaaacagaacgataaatgatttccataaatagtaaggcccagccgacagcctgcagcgcaaaagtgaaccgtttccatctaacttggataatctgcattgttcccaacgaatgacagaatccatcgccagatctaataaggttcaattttctctatacgacggctataaaaggaagttttccgagcgcgcttcgaagcagaatagggaggaccccagacccgttttagtgcctgtccctttttagtacgtgtttccgtttccgtgcctggctagatccatctttcttcgcgcgtttattttcagcaccatgttttaggtttttacagcatcgtttaaggaacccaacaatacaatagcgggaagaatgcactttctcgttccataaagggtctctttcacctatacggttggtacagatttccagtgtatgccagtcagccacggcattacgtcgtttgcttctattttcttcgttttgaactgcgtttgtatgcaactgtcccttgacagagaaaaaagtgaagcaaaatgacagacaaagaaatcttttgtataaaaggtcggttgaatcttgttgttagcttgaaatcagcttgcttttctcctctaaattacataaaaaaccaagaaaatatcagactttttcattcgctttcaacaagtactacaataattaaaa

SEQ ID NO: 176 - DNA, 1100 bp, Saccharomyces cerevisiae
ccgtatctaacgtaataaacgatatctattttcgaggcgctcgacatctcgtatctgggacagaaagtgaggtagattattcaagaatacctattaagaaaggtagaaggtattgcaccgattcctagtatcaattcttttcaaaaccacttattttgcaaaacatgcgtctaacctgccatttcagcaacgtaaataataattacttccatatatattcttctcccccagtagcaattttgacatgacaaatttcagcgatagttgcttcggcattcgaaaatcgtagaagtatgtcttaatgtagaaggttgagaacaaccggatcttgcggtcatttttcttttcgaggaaagtgcaagtctgccactttccagaaggcatagccttgcccttttgttgatatttctccccaccgtaattgttgcattcgcgatcttttcaacaatacattttatcatcaagcccgcaaatcctctggagtttgtcctctcgttcactgttgggaaaaacaatacgcctaattcgtgattaagattcttcaaaccatttcctgcggagtttttactgtgtgttgaacggttcacagcgtaaaaaaaagttactataggcacggtattttaatttcaattgtttagaaagtgccttcacaccattagcccctgggattaccgtcataggcactttctgctgagctcctgcgagatttctgcgctgaaagagtaaaagaaatctttcacagcggctccgcgggcccttctacttttaaacgagtcgcaggaacagaagccaaatttcaaagaacgctacgctttcgccttttctggttctcccaccaataacgctccagcttgaacaaagcataagactgcaaccaaagcgctgacggacgatccgaagataaagcttgctttgcccattgttctcgtttcgaaaggctatataaggacacggattttcctttttttttccacctattgtctttctttgttaagcttttattctccgggttttctttttttgagcatatcaaaagctttcttttcgcaaatcaaacatagcaaaccgaactcttcgaacacaattaaatacacataaag

SEQ ID NO: 177 - DNA, 452 bp, Saccharomyces cerevisiae
aacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaa

SEQ ID NO: 178 - DNA, 978 bp, Lactobacillus plantarum
atggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaa

SEQ ID NO: 179 - protein, 325 aa, Lactobacillus plantarum
MDLFESLAQKITGKDQTIVFPEGTEPRIVGAAARLAADGLVKPIVLGATDKVQAVANDLNADLTGVQVLDPATYPAEDKQAMLDALVERRKGKNTPEQAAKMLEDENYFGTMLVYMGKADGMVSGAIHPTGDTVRPALQIIKTKPGSHRISGAFIMQKGEERYVFADCAINIDPDADTLAEIATQSAATAKVFDIDPKVAMLSFSTKGSAKGEMVTKVQEATAKAQAAEPELAIDGELQFDAAFVEKVGLQKAPGSKVAGHANVFVFPELQSGNIGYKIAQRFGHFEAVGPVLQGLNKPVSDLSRGCSEEDVYKVAIITAAQGLA

SEQ ID NO: 180 - DNA, 2367 bp, Lactobacillus plantarum
atgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataa

SEQ ID NO: 181 - protein, 788 aa, Lactobacillus plantarum [sequence omitted]

SEQ ID NO: 182 - DNA, 804 bp, Saccharomyces cerevisiae
atgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatgtggcccagctggatatcactcaagcagaaaaaatcaagcccttcattgaaaacttgccacaagagttcaaggatattgacattctggtgaacaatgccggaaaggctcttggcagtgaccgtgtgggccagatcgcaacggaggatatccaggacgtgtttgacaccaacgtcacggctttaatcaatatcacacaagctgtactgcccatattccaagccaagaattcaggagatattgtaaatttgggttcaatcgctggcagagacgcatacccaacaggttctatctattgtgcctctaagtttgccgtgggggcgttcactgatagtttgagaaaggagctcatcaacactaaaattagagtcattctaattgcaccagggctagtcgagactgaattttcactagttagatacagaggtaacgaggaacaagccaagaatgtttacaaggatactaccccattgatggctgatgacgtggctgatctgatcgtctatgcaacttccagaaaacaaaatactgtaattgcagacactttaatctttccaacaaaccaagcgtcacctcatcatatcttccgtggataa

SEQ ID NO: 183 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 184 - DNA, 1503 bp, Saccharomyces cerevisiae
atgactaagctacactttgacactgctgaaccagtcaagatcacacttccaaatggtttgacatacgagcaaccaaccggtctattcattaacaacaagtttatgaaagctcaagacggtaagacctatcccgtcgaagatccttccactgaaaacaccgtttgtgaggtctcttctgccaccactgaagatgttgaatatgctatcgaatgtgccgaccgtgctttccacgacactgaatgggctacccaagacccaagagaaagaggccgtctactaagtaagttggctgacgaattggaaagccaaattgacttggtttcttccattgaagctttggacaatggtaaaactttggccttagcccgtggggatgttaccattgcaatcaactgtctaagagatgctgctgcctatgccgacaaagtcaacggtagaacaatcaacaccggtgacggctacatgaacttcaccaccttagagccaatcggtgtctgtggtcaaattattccatggaactttccaataatgatgttggcttggaagatcgccccagcattggccatgggtaacgtctgtatcttgaaacccgctgctgtcacacctttaaatgccctatactttgcttctttatgtaagaaggttggtattccagctggtgtcgtcaacatcgttccaggtcctggtagaactgttggtgctgctttgaccaacgacccaagaatcagaaagctggcttttaccggttctacagaagtcggtaagagtgttgctgtcgactcttctgaatctaacttgaagaaaatcactttggaactaggtggtaagtccgcccatttggtctttgacgatgctaacattaagaagactttaccaaatctagtaaacggtattttcaagaacgctggtcaaatttgttcctctggttctagaatttacgttcaagaaggtatttacgacgaactattggctgctttcaaggcttacttggaaaccgaaatcaaagttggtaatccatttgacaaggctaacttccaaggtgctatcactaaccgtcaacaattcgacacaattatgaactacatcgatatcggtaagaaagaaggcgccaagatcttaactggtggcgaaaaagttggtgacaagggttacttcatcagaccaaccgttttctacgatgttaatgaagacatgagaattgttaaggaagaaatttttggaccagttgtcactgtcgcaaagttcaagactttagaagaaggtgtcgaaatggctaacagctctgaattcggtctaggttctggtatcgaaacagaatctttgagcacaggtttgaaggtggccaagatgttgaaggccggtaccgtctggatcaacacatacaacgattttgactccagagttccattcggtggtgttaagcaatctggttacggtagagaaatgggtgaagaagtctaccatgcatacactgaagtaaaagctgtcagaattaagttgtaa

SEQ ID NO: 185 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 186 - DNA, 1000 bp, Saccharomyces cerevisiae; identical to SEQ ID NO: 171

SEQ ID NO: 187 - DNA, 1000 bp, Saccharomyces cerevisiae
ggttgcccagtgaaatgaagtatttcagacaggtcacttcattgacgaaagatccaaacaaaaaaaatgctttgataatgggaaggaagacatgggaatccataccgcccaagtttcgcccactgcccaatagaatgaatgtcattatatcgagaagcttcaaggacgattttgtccacgataaagagagatcaatagtccaaagtaattcattggcaaacgcaataatgaacctagaaagcaattttaaggagcatctggaaagaatctacgtgattgggggtggcgaagtttatagtcaaatcttctccattacagatcattggctcatcacgaaaataaatccattagataaaaacgcaactcctgcaatggacactttccttgatgcgaagaaattggaagaagtatttagcgagcaagatccggcccagctgaaagaatttcttccccctaaagtagagttgcccgaaacagactgtgatcaacgctactcgctggaagaaaaaggttattgcttcgaattcactctatacaatcgtaaatgaaacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaa

SEQ ID NO: 188 - DNA, 1000 bp, Saccharomyces cerevisiae
aaaagtgtagcacctttcttagcagaaccggccttgaattcagtcattattaatttagtgtgtgtatttgtgtttgtgtgtctatagaagtatagtaatttatgctgcaaaggtcctaatgtataaggaaagaatatttagagaaaagaagaaaacaagagttttatatacatacagagcacatgcatgccatatgatcatgtgtcgtcgcacacatatatatatgcctgtatgtgtcagcactaaagttgcctggccatccacgctatatatacacgcctggcggatctgctcgaggattgcctacgcgtgggcttgatccaccaaccaacgctcgccaaatgaactggcgctttggtcttctgccatcgtccgtaaaccccggccaaagagaccggaaagatcggtgaaaacatcttgatcttgctcccgggaattttagattcaggtaggaaattgattacatcaatactgttaccctgaatcatattcgacgatgtcgtctcacacggaaatataattcatttcttggttttccaaaaaaattttcattttttttcacttttttgtttcgtcctcctttttttttttttttttttattttttttcctgtgttcacctttttttttttcagttgacatctttctgcattcttttctgtgtttttttttttttttttcgtttttccattgttcgttcgttgcctgttttttcgccctattgttctcgagcctaaaaattttttcctttcctgctttcctttcttcgttcaaagtttcctattccattgttctctttggtaaactcattgttgtcggaactcagatatattcaggtcaatttactgtacttcaattgacttttttcttgaaatttcaacttgccttttcaacttgttcttcttttttaatcttattctacactttagttcccttaccttgttcctaattattgtctagcaaaaagaaaacatacacctatttcattcacacactaaaac

SEQ ID NO: 189 - DNA, 1000 bp, Saccharomyces cerevisiae
catccaagaattttatctacgagaatgggacacaaatacaattcttatcaatcattataaatgagcaagaaaaatttggcagtctaggaatgaaatcggaagggaaatgaacggctactttttcgggaagattgtttggaaaacgaagagttgttctttgatgaatgcgatttccaagcgttctttgtgcggaactttaataaccttttaagaatccaaggattaagaaaaatcccacttagaaagaagagtagccgaacgttcttactctcatatccctacttaggttcagttagccgtacatatcaaactacaataatactgccctgctaaattagcggtaccctcttttaaatatgtatctgtttgatatcaacttgtctcattaccatccgcttctcagcggctaaaattacgtaattgcaccaaggcatttgccgagagttcacaagtttacagaccctaacagtatacgactcccaacacacgtttaatgttgtacgaattcaagagatggaaatatttcctccgcggaagccgtttaaagcagactgaattcaggcttagacaataagcttctgtacgagggtccaaatctaaaattcggatattctttttgaccgaaaaaggaaatgtcacaggcacagaaaagggttttataaggcacctcggcacccctataattggcattcccacattctgcgcatacgaatacacataagcgccataaaacagtactccacatacgaaacctatgaaagatttatgattcgttcagaaacaagagcatctccatagagataatgagattgtgtgaaagatgagatatagagaatatttgatgaggaactggtgccagtcagcgatcgtttaaatagcaacaacccatgagggaatgggtataaatagagctgcttcaactatatgcctttgagaatatgtctttattctttcctttcctgttaagcttatatcagcactaacaaacaaaacaaataca

SEQ ID NO: 190 - DNA, 1000 bp, Saccharomyces cerevisiae
ccccactatcgctcctttcttatctgaattgtatttttgagtggcctaattgtaatcttttattttgttttctaattattgaaggcggtttctcgaagcatttcacgatttccaaaattcaagaattgaaattatgaacatagaagacaaaatactttttttatcaactattaatacacctttcctagagaacatttttaaaataaaataaaataaagtagcgctctctactacccttacacttttctccttcatatctggctagaaaagagggattacatctcggaatcaaatatttccctctgtgcaaagttttaatactgctactacgaactggttacaattttatttttatcatacacgatactttgaacatcaacttctctcaataccatccgccttcagcggctacaattacgtaattgcaccaaggcattcgccgagagttcacaaattgcagaccctaacagtatacgactcccaacacacgtttaatgttgtacgaattcaagagatagaaatgcttcttccgcggaagccgtttaaagcactgaaattaggcttagacaatagacttctgtacgagggtccaaatctaaaattcagatattctttttgaccgaaaacggaaatcacaggcgcgcaaaagggtttttcaaggtaccccggcatccctataataggcattcccacattctgcgcatacgaatacacatgagtgccataaaacaatactccacatacgaagtctatgaaagatgtatgattcgttcagaaacaagagcatttccatactgataatgagattgtgtgaaagatgagatatggaggatatgtgaggtgctaaatgagcgtctgttaacgaatcgtttaaatagtgatgactgatgaaggcatgggtataaatagagctgcttcaactgtatgcctttgagaatatgtctttattcctttctttcctgttaagcttatatcagcactaacaaacaaaacaaataca

SEQ ID NO: 191 - DNA, 1000 bp, Saccharomyces cerevisiae
cgggtggcgcgttggctgactgagtggaagctgcattgatattggcgctggagccagatttacctgtattttccagcggcaagaactccggggtcagcctcttgtactgggatagaattctctccttcatgatggtgtaagtcacaaagactatgacggctagggcaaacaggatcagccaaaaggaaagagtgaactgaacatggtgtaacttgaagaagatccacttcggaatccttaaaagcgataaagttgccagataccaaccgtacctgaagatcatacgagaggcacccataacaaagtaggacacaacccacgagaagttgaagagggatgaaagtgaccacgtctgcgcctcagaaataatctggtcggtgagacatgtctggaatctataagaagtataattactggaattaaagctggagccaagactgtttttcgtgttttggccggtattgttggtgttgttcgtagtgcaattcattgaacgcatgcaaaaactagagccaagcctttctattcttttcttgtttattttatattcgttagagttttgtggtgtttctttaacttaataaactttcgagaaaagtgtcaagtttcccagatttttaagatccttataacctgtaaaaaaaaaaaaaaaaaaaaaaaagaagggtttaaataaaaatcggacttactcaaagggttgaaaagcactttaatataggtttttagtttcgggtaagaagatgtgtcaaaggtctcgaaaaggaaacattagggcaaatacgtaaaggttgccttcgtatctcgtttccacagcaacgagaaacgagatacgaaggcaactgattcccagcatataaaaggccatgaatttttggcgtttcctattgtcttttcgaaactatttctttcattcctttcctttcttgttcttttacttataagaaaaataatatacgtatatatataactacaaaccacatcagcaataaaaaaaaactat

SEQ ID NO: 192 - DNA, 1000 bp, Saccharomyces cerevisiae
acatcgtagccttcagatacgttagcaataataaaaaaatgaataaatatttactacaattgaaactgccacctgtttatcatttttcaataaggagatgaactaggccatcaacaattactaacacgcacacacgcactactacaactacttgattttgaattatatgataccaagtgcctatgatttacttaataacaacgctcactgtattgttttattatcgaaatataagacgatgaaattgaagatgagaagtgaaccactcacaccattccgccaaaaatcacattaaaatttcaaaaaattacttacgcggatacagaaacccccttcggcagctctttagatatcaactatttgactactatctgcttctcagaagcctacaagtacgcaattgtttcaatgaatttactgagaacacctaaaactacagattctaacaatatacgactcccaacacatgtctgctattcttaattaaacttttaggaaagctataatatagttatttttcttccatggaagccgtttagaacagactgagtatgggctttaacaataagcttctgtacgagggtccaaatctaaaattcggatattctttttgaccgaaaaaggaaatgtcacaggcgcgcgcaaaagggtttttcaaggcaccccggcacccctataattggcattcccacattctgcgcatacgaatacacatgagtgccataaaacaatactccacatacgaaacctatgaaagatgtacgattcgttcagaaacaagagcatctccatagagataatgagattgtgtgaaagatgagatatggagaatatgtgaggtgctaaatgagcgtctgttaacgaatcgtttaagtagtgatgacagatggaggaacgggtataaatagagctgcttcaactatatgcctttgaggtatgcgctttcatttcactatttcttgttaagattacatcagcactaacaaacaaaacaaataca

SEQ ID NO: 193 - DNA, 1000 bp, Saccharomyces cerevisiae
tgcaaaaactgataagggctttcctgctgatgcgcttgctgattttgcgtatttgccgaagattgattgatcaattgcgtaaaggggtcgtcttcttgacggttgatattgaatagcatgttttgaatacgtagttgattgacctctttcttttaattgcgtgcagctgctctcaggtttaagatgtacgagggtccacggggtagcaagcacaagaacgatgatatatatgacagaacgatggataagaatggtatgttgtctgcactgttcagcattcgactacccctctcccggttcttttctcctcgtttcaatttaaaaaagcaactcgctacccggccgcacaccccttattcctgttcagccgtttaaggtgagaaccctttacttcatagcctttgtagatctttctattgctaccattgaagggtcggtgacgtggaaattttgacatttatcagtggcgtattgggaggcaagcaattgaaagaactgtgatttatttccgcttgttcgaaattattgatgtttagcactttgcagtagcgacaatacaatatatgtgcttttagtgctgggatagttcgtagctccatttcggggcgcttgttacatttattgtatatgcgcggatgtggcacatgctgttgagatctcactcctttggtatctctttcctgcgccgcattgtgccggcagaatgtcgcgcttgtattctcatgaacttttcctctttacgaaccctttggcggcatgccgtttaaaatctgttgaagatttcctttacgaacaatgagcaatgttttgcacaggcaggtgggaagtagggcctatcgcgccttggatgcagatataagtataaatataaattataataattggctgtatcagtaaatccttcttgcgatgggaggaagcacgatagagtatgttaagcttttgagaggcttcatattcattggaattttaaataacaataaagcaacaacaataataa

SEQ ID NO: 194 - DNA, 1000 bp, Saccharomyces cerevisiae; identical to SEQ ID NO: 172

SEQ ID NO: 195 - DNA, 1000 bp, Saccharomyces cerevisiae
ttttactcttaattcaaataagcactgctattattacttttgatcacgtcaaaagatacaaaagacaatctacaagtttatggccttgcattgtttataatttatgtgctatctgagcatacccgccttttctctattgttattcgagagaagactaaaaatatctgctgcaagaacaaaaatgggaactgcttgtctcttaaaattatcaatccacaatggaaatagactttttttacacagcaacggtttttgaatgctatgaaacggtcattatcagctaacacgctcaacactttactccatcttcttaaagggtgtaaacagaacgataaatgatttccataaatagtaaggcccagccgacagcctgcagcgcaaaagtgaaccgtttccatctaacttggataatctgcattgttcccaacgaatgacagaatccatcgccagatctaataaggttcaattttctctatacgacggctataaaaggaagttttccgagcgcgcttcgaagcagaatagggaggaccccagacccgttttagtgcctgtccctttttagtacgtgtttccgtttccgtgcctggctagatccatctttcttcgcgcgtttattttcagcaccatgttttaggtttttacagcatcgtttaaggaacccaacaatacaatagcgggaagaatgcactttctcgttccataaagggtctctttcacctatacggttggtacagatttccagtgtatgccagtcagccacggcattacgtcgtttgcttctattttcttcgttttgaactgcgtttgtatgcaactgtcccttgacagagaaaaaagtgaagcaaaatgacagacaaagaaatcttttgtataaaaggtcggttgaatcttgttgttagcttgaaatcagcttgcttttctcctctaaattacataaaaaaccaagaaaatatcagactttttcattcgctttcaacaagtactacaataattaaaa

SEQ ID NO: 196 - DNA, 1000 bp, Saccharomyces cerevisiae
aactttggtagccatttgttctcaaaggaatctgtgttggctgggttattaaacgtggaactttggaaatacatccaagaggcacaattgagctctaacgatgagccgttacgataaagatagagacatttcttttgacttagaaattacaaggagtatcaactattaatatatttttcctagaaaacgtttttagaatagaatagaacaaattagcgccatctattgcccttacacttttttccttcatatctgactagaaaagggggaatacatctcggaatcaaatatttccccctgtgcaaagttttaatactgctactacgaactggttacaattttatttttatcatacaagattctttgaatatcaacttctctcaataccatccgccttcagcggctacaattacgtaattgcaccaaggcattcgccgagagtttacatatttgcagaccctaacagtatacgactcccaacacacgtttaatgttgtacgaattcaagagatagaaatatttcttgcatggaagccgtttagagcagactgaatttaggcttagacaataggcttctgtacgagggtccaaatctaaaattcggatattctttttgaccgaaaatggaaacttcgcaggcgcgcaaaagggtttttcaaggcacctcggcacccctataattggcattctcacattctgcgcatacgaatacacatgagtgccataaaacaatactccacatacgaagtctatcaaagatgtatgattcgttcaaaaacaagaacatcttcatagtgataatgagattgtgtgaaagatgagatatggagaatatgtgaggtactaaatgagcatctgttaacgaatcgtttaagtaatgatgacagatggaggaacgggtataaatagagctgctccaactatatgcctttgagaatatgtctttattcttttctttcctgttaagcttatatcagcactaacaaacaaaacaaataca

SEQ ID NO: 197 - DNA, 1000 bp, Saccharomyces cerevisiae
gaagtagacacgataaagttcttgaagaaagattgtggatgggtttgctgaagcttagaactaagaaaagaaacaagcacgcgcaagaaaaccgctacggctaacttctaaggtgaggatattgtgattgtttatgcctcatattttgcgtttttatatgttcttccttcatacggcgtgcaaattatccgccggcgaacagggtgctattctaaaaggaactttgaaactgtaaacgcggtgtactgaaggggtcatctgaacgaacaatattttatgcttttgttagccaaacggtactgataagggactgtgaaaaaaaaaagacaatgtatggggttcacggtttcccagattcgtgtgtgtgtaataattcgtttacggcgcacgacagacacttcaggaaatttaaagatcagaataggcatacactccgcgcaaggaaaacaaaagttgctaccgtaaccggctcgtacggggaaagcaaggtcatctagtgctcacttacgaactggcataatcgagttgtgacttccaaacttaaccgtactctcacagctgatgtgatccgaagaaaaccctgaagatacaacaatggcaaccaaaggcaacttaaaaaggcaaacgaagtacttttcaacaatagcttacactgaaactcgcggagaggcgacgctgcgcgcgaattatcagtaaaaatctcgtaacaacccatctgccacttttagaaggaatggaaattctcaaaaaatgacggaaaataatagaacagggttcctaaacgatgcatttctaacaagtaggatagtccaaaagggaggatgcaaattctttgttttccacgcagtaagatatgatcccaagctttcgaatataaaaagggaaggatcgctaggacagatcagtttttagcccgtttacttatctcgttccctactcttgttctgatagaaaccagcaacaaaaacctattcactcgcttattaataccataaaaaat

SEQ ID NO: 198 - DNA, 1000 bp, Saccharomyces cerevisiae
tcgggaaatgttcgcttccatttggggttattattgctaaacgtcaaaagttattctagtttatttcgtcgaatatgatttctttttgcacgtgacttttctccgattatcctgggcggctatttctccgctgtttaactagggaccaattattccatcaacaatgtgtcgagtcgatcgttaaccatctgtcatgtttcataccttattctaggcatatatgggcccaccatatatttttgagccttagacttttcgtatttggggtacatcagcttccattgctacagaactatttgagtctcaaccattagctatagagctagtcggaaatggcgggaccgaaacaacttttgatagtacagggaactccagcgtatgtttctctaggtgacaagaaataaaactggagacaggcgattgacagaaggatcagaagcaatagtcttactacttatagacagagaaaaatgattattccatatgttaccctgatattctacgagaaaatgggccttcgtcaatagctatttaatttaagcatatgtacgggcagtaccagctgttatagtttacataaaatagacatattcacgtgtatgcaagggcacataaaagcaaaggctgacattgaaacatagcaagccaagagatagaaaaggaggatacggggtgaacagccggtctattcttatatatacttcaaagaagcgatagttctgtccgtataaaaactcggacaattcggacagcactccgcgagaaaagggctcgttgggcagctcaacattattcaacgcaagcctgttgagctcaattggttttaattgtaaatactcaatggtgtcaacagctaaatgatttacactcatatatatggtccggatatatggacgcagaagtaaaataaaaatgaaaaaaagtagaaaaggaaattaatttcttaaagttcttgtcagcgcatataatattggtataaaggtacatatatattgacagt

SEQ ID NO: 199 - DNA, 1000 bp, Saccharomyces cerevisiae
gtaaaattgtggacgagattcacgctggtgttcttgagccaaccataagcaaagtcaaatccttgaaatcagcattggaggcttgtgtagcaattctaagaattgatacaatgattacagtggatccagaaccacccaaagaagatccgcacgatcattgattctttgcgtaatccgaacgagattctgtatctgcatgtaaactaataaacctatataaaatttaattatatttttttcagctagttctatttttgaatttgatcgctaactctgggcagttgataagcgcttcccagcttttcacgtgcgaggtggactaatacgtaataacgcgtacctattaggacttcgttgagttgtttttcttgtccaaatgcagaagcgggtccctacaaactattgtgtttgttcgtaaacgagcaggaaccctgttaaaggaaaaaagcttaacgctagcgttacattttagtaaggcggcaataaaaaagaatgcggagtgtattccatgaattcaattgcgcttactgctaagcctgtttctaaacatgatccccagggtgaatatctcccatagtggctgtgttattctgtctaaatgtggcagctaaataaggttttttccaagctatttttttctctaaacgagcgcaccttagcgggatcgcgtcaaattttcgcccaacgaatattattctattgtcttcagtgaatgtgcttgtcgaaatctatatatgcgccgccctggcaggatcagcaaatacaagttacttggaaagtcgcggcatagaaagtagacacttcttttgtcaaagattgatattgctttcagggtgcgatagtgctgactgttcctctaaacagcgattttttacatacattaactttttgaagttgtaggaactatcttttctcatttatccaacactaaaacaaaattgagctttccagaaatagtgaatcaaaaaaagttaagtacaaatatttacagttcagcagt

SEQ ID NO: 200 - DNA, 1000 bp, Saccharomyces cerevisiae
catgcagggtggacattcaattaatttttatcgctttttaacgattactaatccagtattaccaactacaatcactcagtcatgtatcactaataacgaaaagtaagctgtacaatgctcatcttcctagcactactagtactgctactatgagacaccattgaagtcttcttcaagacccccattatgagaacacttggctcactatacaatcggcgggagatgggttgttattatagagagtttcaggaaaagcactcctagattctagtcaagtactgcctattgtataagagacgagggcacgagatagcgcagtattttatgatgaaaatatgaaaataaatacttaactcattgagtaagcttagctgggcaacttaactaacagtcaaaaaaaaaaaaaaaaaaaaaaaacaagagccagcaaactgacattaacattgatcaataaaataagaaaaaatgtaccagagaattcgattatgaactgatgacaatatcattaaagactttgcacagtattcaaaaactaatcgagagctttgaccaaaaagtgtcccgactttataatgagaccgccgcttaattcataggagttatatggtatgctttggaaagctattacattgtttgataattcaaaaataagccacaatacttcacctattgtgtaccatgtattataaaacatcgcagctcgtatctgtaaacatacattgacttacattttagtgataacttgggtacttgagtgaagtccatttctcccgtgcttccggaacataaaccaacatagattctctttcactcgaaactgctcgaagctgttgctctttttttgatcgtggctttaactataaaactcaacagctgcgtgatgaacgcgctgtcaacaaatttcatcttgcgaattatataaaaaacactgcgagtgattaaacctcagtaaacttgttacgtacctcataacattaatgtgaaatacactatattgaat

SEQ ID NO: 201 - DNA, 1000 bp, Saccharomyces cerevisiae
tttcgttttagtttagttacaaagtgcttttgccattgcatagacgagcagcttatcccataatgaataaattctattcaaactaataataactaatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaaccattatttttttccatttaaaatgatctttttaccgaccaggcgtcactaaccacgaaaacatagtttaaggtattttccgttttaggcgcaatgaatatactgcaacgtgcctattgaatcctattcgaaatcacctccaaagttatgttgccgattaggcaaatactctaaaagtatagtactaaagaactacgtaaaggtaaaataaaacacctgaatttcatttctgaaatgaagtaccatcatgaaatatgatgaaagtcaagactcgttgggtcaatatacaccacaaaaaaaggtacacacgaatggtttaaccctttcggttccttctgtaaatcgaaaaatgccctttatacagcgggttggtctcccatcaaagttgagaagcgattagaaattaggttacctaatgaatccataaataaatggaaaacgctattttgttcgaacgatggaataaaaatatgaacgggtgtcattgaaattcggtgtattttttgatcgggcctgatctggctcgggtttggcacaatttggcttggttagttcggcaaagcttatttaaagaacctttttggatagccaattgagagacttgaaatagaaagatcgtaagtatttttatgaacgcaaaatcaatcttggtagcccagttagtttctcttcactaattccggagaacaaaaacatatcatacgattgtgtgagattcaacaaaaatcgatcagaaattttttttgaacagaatagtc

SEQ ID NO: 202 - DNA, 1000 bp, Saccharomyces cerevisiae
acagcggtaccaagtgacacattgcgtactgtgtagtatgcgccgtatataactttttttttctgaaggtactttgaattacaatctattttttacagttcctatggcaggggttgaagatatttgggtctgaaccatagcaggattagtgttatagtaggtatgtgaatagaagctaacaaaatgagatgaacctcatacaaagtcgtagagaaaactgctaacagaagagctgcgccttgaaatcgtatctctaagcttataataaattgaaaggaaaaaatacgtggtaaatgcaagcgaccaaaaggctacggcccaacgctaacccgccgataggtgcataatctaatttacctccaccagcaggagccctttttctaagtaataagcaaaccagataacttacatcttgctgtaggaaacaaaagccggaataatggttcactcatattcttcgtgtgaaacacagaagaaatccaatatttgcttcagtatttatctctaaaaattggtcctacattggaaaccataaaccaattataaccggtgtacgaattgtaagctagttctggaaatgtcatgttgcgcaggtaaaagtggagctgaattgtatatctgttttgatcattattatccctctgggtgagtggaaatatcaataaaatgcaatggcacatttaatatccttctcttaattccgtgatttataacatcttgatgccagaaacacctttcggatccggcaataaagcggagattagcacgcttttcgccggtcctacggatttagtgttggctattgttgagattagtaatacgcagagaatttttctaccggtgaagcgaccatctcagattattaggtcaagcaataacacttgttattagatgcgttacgttcacctggaccctatataaaggcatatttgccttacatttggtgtatggtatcaccttgtatactaagaacatatatatgcagatataacaacaggat

SEQ ID NO: 203 - DNA, 1000 bp, Saccharomyces cerevisiae
tggtataatcaagcgtatttagaagtttgggcgacagtatttcaagacgagatgcataagtattctcttcatcctcaatcccgcgatgctaaaacaaagttttgttgttgcattccatttaagtagagcaaaagcgtggcaaatctgaaaaattgccacatagggtgctaaatttggtataatggcacaaataaacaatctcagtttactgacagtgaactacaggaatatacaattttgaggtgttaacgaccaaccgttaatagcttattctctcatatgttataccactgtaggaagaggtggtttcaactgtattttgagcacaggtagatataagctctggacagttttgctaccccttgaaagaattcaacagtattttctgaggtactcatcgtaaaagattgctaattttggtcgcgatgtatataggtaaaggagtatttcctaaaagttgccaaagattatcaaaatattaccgtgtttataaaataaactgacacccggataattaagaagtggtaagcttatgttagagtacttgtacttgacaagtaaaatcagaattgggaattatcaattgagatcacgtgcaaaccgaagaaatgcaaagaagtaaggttagggtttatggacccaggcagcagaaaattgtagcttcatttgttggcacaggactattccacccttagaattgactttttggacattgagctaaggttcaatgcactcgatggtcttctcacttccgaatatatagatctagcgtgtgaggactactcattggcttgcgatttacggtttttatattttttgccgcacatcattttttggcctggtattgtcatcgcgttgagcggactctgaatataatcctattgttttttatggatctctggaagcgtctttttgaagccaacccaacaaaaattcgagacaagaaaataaaaaacggcacttcatcagtatcacaaataccatcaatttatcagctctc

SEQ ID NO: 204 - DNA, 1000 bp, Saccharomyces cerevisiae
cttcgaataacaacagcaagaggctctaggatgaagtcttcccggaaaccattactccaaagtaggtagctgtggaaagcagcttccagataatagtaaatggataaccgtttctaagcgaccttatttcagtcttgaaaatacttacccattttgcatcgattgggaactgagaacctacaagccgtaagattgcgtagctttctcttggggtccgtgagatccgtattctgcattattactgcatctccaacgaaactacctcattgtgtgaaactactatttcttgcaagaagttatgactgcgatgcaaattacaaaatatacaattgtaaaacggcttaatagaaagacattagtagcccttggtcattaccttcatattcaaataagctaatgatcaaataaaaaagcccaacgatattgcctgttgcatctaaaattttccaagtcaaacgagttcatattatatactatgtatggaatatatatatataatttttcattttattttcaaaaaatgccactgcgcaaatctctgtccatcagtactgttctttacaattttatcgtgggaagttgcggaggggcgtgttggctagcaaaagatagtcatgtcgagatgactcgcggatgaagtctcgcgtcttcttcgaagccattttgccggcatttggttatggaaaaaagttgttgaaaagtgcaaagcattagaaccgtccctgtcacgctggtgcccccacagatttcacgtgagagacgatgcctgaggaaaatccgctacgctgctgcctaatctgtatttacaggctatgtagttcgtttgccactctgctagattctcttggtatcttttatttcttctcttaggcagatcttatataaaagggcaaagctttttttgctcccatacttgctgaaaatttttcagatcttactcttctggtagtggtgtcctcagaagagctaacttagccgattattttcaatttagtgcagt

SEQ ID NO: 205 - DNA, 1000 bp, Saccharomyces cerevisiae
aggtagaaggtattgcaccgattcctagtatcaattcttttcaaaaccacttattttgcaaaacatgcgtctaacctgccatttcagcaacgtaaataataattacttccatatatattcttctcccccagtagcaattttgacatgacaaatttcagcgatagttgcttcggcattcgaaaatcgtagaagtatgtcttaatgtagaaggttgagaacaaccggatcttgcggtcatttttcttttcgaggaaagtgcaagtctgccactttccagaaggcatagccttgcccttttgttgatatttctccccaccgtaattgttgcattcgcgatcttttcaacaatacattttatcatcaagcccgcaaatcctctggagtttgtcctctcgttcactgttgggaaaaacaatacgcctaattcgtgattaagattcttcaaaccatttcctgcggagtttttactgtgtgttgaacggttcacagcgtaaaaaaaagttactataggcacggtattttaatttcaattgtttagaaagtgccttcacaccattagcccctgggattaccgtcataggcactttctgctgagctcctgcgagatttctgcgctgaaagagtaaaagaaatctttcacagcggctccgcgggcccttctacttttaaacgagtcgcaggaacagaagccaaatttcaaagaacgctacgctttcgccttttctggttctcccaccaataacgctccagcttgaacaaagcataagactgcaaccaaagcgctgacggacgatccgaagataaagcttgctttgcccattgttctcgtttcgaaaggctatataaggacacggattttcctttttttttccacctattgtctttctttgttaagcttttattctccgggttttctttttttgagcatatcaaaagctttcttttcgcaaatcaaacatagcaaaccgaactcttcgaacacaattaaatacacataaag

SEQ ID NO: 206 - DNA, 1000 bp, Saccharomyces cerevisiae
agtaaggtaaggcttctagttatgaaactggaggtgttagctggaataaaaattgcacatcctttcaccaaaccctttgaaagtagttattgttgtccaaccgaggatgactatgaaatgattcaagacaaatacggtagtcataaaactgagacagcactgaacgcccttaaactggtaacagatgaaaataaagaggaagaaagtattaaagatgcaccaaaggcatatttaagcaccatgtacataggccttgactttaatattgaaaacaaaaaggaaaaagttgacattcacattccctgcactgaatttgtgaatttatgtcgaagtttcaatgaggattatggtgaccacaaagtattcaatctagccctccgcttcgtaaagggttacgatttgccagatgaagttttcgatgaaaatgaaaagagaccatcaaagaagagtaaaaggaagaatttagatgctagacatgaaaccgtgaagagatctaaatcagatgctgcttcaggtgacaacatcaatggcacaaccgcagctgttgacgtaaactaagacattcctatttatagttgaatagtttattaatataggttaatcagtcataaacaaatttgtacccttttttttgaatcaaagtactttttttacgaagcagtaaaacgtttacgagattctctctacatatgctctttcgcgtgtagcgacattttaccattaggtgagaattttgtgttacaagctggatgtcaggatgatacctttgaaggcatagttaaattggctgggaaaggaacggaaccttttcctttccgagtttcggccagatatttaggcttttttttttctgacggaataggggacccaggattgacaaatataacaaaacaagcttcaacgagacgtttatctcgagaattacgtctgacagttacatgaagtgtgagttcatgcaatctgtacctttattgacacagatatactaaaagaagttaca

SEQ ID NO: 207 - DNA, 1000 bp, Saccharomyces cerevisiae
ggatatgattgctgagaatgcgttaccggccaaaacaaagacagcgggattgagaaaattaaagaaggaagatattgaccaagtttttgagttgttcaaaagatatcaatccaggttcgaactaattcaaattttcacaaaagaagaattcgaacataatttcattggtgaagaatcgttaccattggataaacaagtaattttctcatatgtagtcgaacagcccgatggaaaaattacagacttcttctcattttactcattgccattcacaatcctaaataacacaaaatataaggacctaggcatcgggtacttgtattattatgccaccgatgcagatttccaattcaaagacaggtttgatccaaaagctactaaggctttgaaaacaagattgtgtgaattgatttatgacgcttgtattttggccaaaaacgctaatatggatgtttttaacgcgttgacttcgcaagataatacattgttcttggatgatttgaagttcgggcccggtgacgggttcttgaacttctatttatttaattatagagcaaagccgattaccggtggcttgaatcccgacaatagtaacgacattaaaaggcgtagcaatgtcggtgttgttatgttgtagtggctgaaaggacgaggcgtatatagttttcgtgtacatagccgacagaatttgaccacatttagtttttccgcatagtcaattgacgaagtgaaaaaataattaatccaatggctggctttagagtgtcagcctccaaaataaatccaaaaatagacaaagagaatcactataattaccgccttggagtccaagttggcttgagaactcgcatttatttttagcgactgaggtagctgaaaaacgcctactttctcagaaggcggtagtgagcatatataagtatgtaagaaagatcaactcttctggactagatactcaccgatctagtgaaaatataaacaaacccaacatatatataaa

SEQ ID NO: 208 - DNA, 1000 bp, Saccharomyces cerevisiae
gaaaaatccaaatgttcttccttgccaagtactatcatgggcgcatgccaggtacctaagccataggtaacggcctgattacccaaacatgtaaaagccctcaacgtagacaagtctggcttatttccaatttctttagcgactactaccaagtatgctacttccgctgacgttctccccataggcacaaacgtctgcgtactacacggatgcttttcgaggactttgatagaatgagaaatcgcctgattggagccttgagtgaatactctattcaggtgcggctgtggaaagcaacggaataggttccaattgggaactttactggtagatttattctctacctggcttacttgaagcaatttgatcgctgttccctggtttgcacctttttcaaggttttgcatccttgaaatctcttcatctggcgaaattatcgtcccatactcctcgaaggactctttcgtcaatgtctccgccaccacggtcaccatatctttgcttcaaagattttttgccctacaagataagcatcaagagcgattggatgacagttactgacttatatatgcgaatgcacatgaatagaccgcatatgcttcttatcagtcttacctcgcttatctttccccatttatttgccaatccatcttatcttatctggcactttgtctcagggttagtgttacaaaaaggctaggacttatttccaaaattctacttttgaaaataaccctaacaataaaagcaagggcattctgatgttaccctagaaatgtcgtatttctttttatatcgtggatcatgacaaaaaactcaacattttcaaatgggtgagctctaaaccagaaaatacagccgccgaaagccttttaaaaggacagcggcgcttgatcaacagtcgttcttggggtcgttaagactagatcctgcttcccccccttattgtgcatttaaaggcacttattgaaggtcattttggcgaacagaacatttcgtt

SEQ ID NO: 209 - DNA, 1000 bp, Saccharomyces cerevisiae
ctatcttgggggtacgaaacttagcaatatatttagcaattgtcttctgatacttagcactaatgggaattaggtcattatcggcaaataattgatacaaaaaatcatatgtttcctcaactttagaggggccacccatgttcatcaaaacaattcctgtgggtgatctcttttgtgcattctgcatgttgaatgtaaccgaaaatgatcttgtaatggtcagttgtgatcttcttaggaaggaaccttgtgtacggattgttctggaaagcattctttaaacgttcttttttttactgctaaatttgtccaaatagcaggtatgtgttaaatatttctgtacttcttgtaaaccgactcaagtggaacacgagaatttacgcttgtttggtgtcaagccaagagtgaccttgaccgaccaaaagtattccttcgcgtcctccttcttcaatcccatatcccctacgaaaaaaagcagcatgagaaaacgaagggcagcaactccttcgtcatataaggcttacggtgaccattgaagattgggcatgtctaacggctattgccagcggagatgtttcaaggcatcctacacatgctacatatttgtaattattttactgagtttgtgtatataaaaaacttttttaaaaaaaaaaaatggccagcatcctctttcatgtaaagctgttgaaccttcctgaaatttacttctaaaattgttcagtaaaactgcttgttaaaagtgcgaagagttcttttttagctttttttgtcctgctgttgagctgttttgctttactgttcaacaaaacattgaagatctttcacattgcgcgtcgaaaccacaaaccgtcgaaaacaatggtcatctaaataaagggttcttattaaacagatttaaagccaaggacaaaatacaggcacaggtcaagcaagaagacaaaccgcatacgccaagacaaaccgtggtgatttaattctgctgctgatcgcttccaac

SEQ ID NO: 210 - DNA, 1000 bp, Saccharomyces cerevisiae
atgagcaccactaggtcagttctagagcatttattaaaatcagcgggcagaattacttttggtatcccttgatcctcatgtatattttcggaacgttctcctgatgtgctttccatgatttctatgagtctccaaaggatatcctcgtcttatgatagcttgcagacttaaatttgataaacacttataaaaagaaaggttatctgcctctcgaagtatataactgatcactggaacgctattggaaacaatacggatgataaaattggaatataaataatcttaagaagaaaaaaaaaacaggtaggagctataatcggctaaagagaaaagaagaaaagttgcagtgtatacggatgagcactttcaaagtaatatggctatttatgatggcttggggcattagattaaaggaaagccaatatacgctgaataactttctgaagtttgaatcctttattcatcaaatgaagaagagatcctaggatgagtatggagactgattgtttgttaaaatcttataacccgtatgtgtttccaaggtggtttacagaagcctcaggctctcacctacgggttaaaatctgactatggtacaagcacgttcgcctcattcatattttccatagaaagcggactcaaattttgaaaccgcattttagaaagaaaaactcgatagcatgttaaatattttaaagaataccataattcgttaaaaatacaaaagtgtactgatatcgtacttcctctagggtagcactaccttgtttaggccagaaattaagtaacaaacttttcttgtttgcttcgagtatactaaaaaacagacactcggggttaataggcggtcttccgttgttgagctcttttttttttagaaatccaacatctcttcgaatagtagattagaaatagtatttatgtcagcgttccttgagccaaatgtactaaatttcccgtcgttttaattatgctgcatgttggagaagaatcattccaa

SEQ ID NO: 211 - DNA, 1000 bp, Saccharomyces cerevisiae
tttcatgataatggtgtaatataccgtgatttgaagttggaaaacattctattaactccagaaggtcatataaaaattgccgattatggtttgtgtaaagatgaaatgtggtatggtaatagaacttctacattttgtggcacaccagaatttatggctccagaaattttaaaagagcaagaatataccaaagctgtcgattggtgggcatttggggtgctgctatatcaaatgctactgtgccaatctccattctcaggagatgacgaagatgaagtttttaacgctatccttaccgatgaacccttatacccaatagatatggcaggtgagattgtacaaatattccaaggcctattaacaaaagatcctgaaaagaggttgggtgctggtcccagggacgcagacgaagttatggaagaacctttcttccgtaacatcaactttgacgatatcttaaaccttcgcgtgaaaccaccctacatcccagaaattaaatctccggaagatacatcatatttcgagcaagaattcacctctgcgccacccacacttacacctctgccctctgttttgacaacgagccagcaagaagagtttagaggattttcctttatgccagatgatttggatttatgaagaaaaggtcatgccatgatttatttaattttatataaaacatctaagcggaaaagttgaactgttccgcttcataggaggagagggtttttttaatgagattttgttacataaactgaaactatccattttgatgcaatgcctcttttttgttcgtacctatcttggagcatgcatatgaaaaacctcgtttaagcgatgcgatgcgaagccgtatgttcaacaatgcgcattctgtttacattattaaggaagcatttaagaaacagctcagtattatattactactaacatatttctaaagttgacagattataaaagttacaaaattgtcaattgaacagatacaaaaattttataa

SEQ ID NO: 212 - DNA, 1000 bp, Saccharomyces cerevisiae
ttgataacattgagaaatttgctagtccgaattatgtctgtacggatgaagacattttgaagggccgtataaagactacaggcattacagaaaccgaatttaacatcggctcgtccaaattcaaggttctcgacgctggtgggcagcgttctgaacgtaagaagtggattcattgtttcgaaggaattacagcagttttatttgttttagcaatgagtgaatacgaccagatgttgtttgaggatgaaagagtgaacagaatgcatgaatcaataatgctatttgacacgttattgaactctaagtggttcaaagatacaccgtttattttgtttttaaataaaattgatttgttcgaggaaaaggtaaaaagcatgcccataagaaagtactttcctgattaccagggacgtgtcggcgatgcagaagcgggtctaaaatattttgagaagatatttttgagcttgaataagacaaacaaaccaatctacgtgaaacgaacctgcgctaccgatacccaaactatgaagttcgtattgagtgcagtcaccgatctaatcatccagcaaaaccttaaaaaaattggtattatatgaaggaactgtataattaaagtagtgtttagatacgtaaattctgtttccgaagatgcaagaaggagcagcagcaccagaaaaaattactatttttcttctccattagagtctatgatggaatgccaaatgaaaaagccattttgttcaacagttcttgatctcgttaaatcgttccgggttttcaattgaaaaacaagggtaataaaatcgcatgagaaaaaaaaggtccagacacttttttagaagaaaaactcttgaaaacaattgattcttctacgtaaggacagggtattatctcgaattcttctccctggtaaatactcgggatatatagaacctattttgcatcctattctcacttttctttattgttgttaatttctggacattgtttcattaattga

SEQ ID NO: 213 - DNA, 1000 bp, Saccharomyces cerevisiae
cgggcaatgctttggtgaattattctaacttaaacactaacacttttattggtgtcttaagtgtcattagtgccgtcttcggtctaatttaggctctttcttcgtttctatttcttttctaaaagaatacgagagtgagaaaagcgcaaaaatatcaacatacaaatagtttacgagatctcaagtgcataccgcatcttatttttacaaactcgaaatcttacgagcattaacatttacataccgggtgtcttccctacatatatctatctatacagatatgttcatgcagtactttcatcgaagatatatagataggtttaaagtgcagaaggaaaaagctaggattgcagatatgccatctgcaggccaaatttcacttccacatatctgcactgttcatgaaaatgatcagtttctttctttcttgcagctttagataatctggtttttctgcttttacaccttagagatgaatcaaagacactcaattcggttatacgacaaagggcgaacacaatgatgattctcacgactaaattaaggacatacttttcaatggtgatgcctatagagaatttaccgtcgcacccaatgcagccggtctggccaaactgggaaataaggtttttcttggctcgtatacgccttcgaaaagctcctacaaagggacgcgtcgcctttttcaacaattttttaccttgcggacatttcttccgcatattctccaccttggcattgtttaccaacagaagaaagtgaaaaaaaaatcaaaaaaaaggtaaaaaaaggacaaagagttaaatagtctgagaatcttcttcttttcgtatctcatgtggagtagaatataccttatatatgagcacaattagttatctttacaaggcgttagaaatgtcttttagcttgtttttccttagtgtgccttcaaatcttatcaagggttagaagtgagttaaaattcactcgcgctggtaaagtaacacttcttacgcag

SEQ ID NO: 214 - DNA, 1000 bp, Saccharomyces cerevisiae
gtagcaaacttatcttttagagtgtttgtgcttactgcattgtcagatcaaaatttacgtagccgcccttttcaacccctgtcgaagagtagcataacagcagcgtagtgaacgtgcatgttcacaaatacacgtacaatattaatatacaatagtaaggtgatgaacacacacacacacacacacacacacacacacacacacatatatatatatacaggagatcaagttagtgtgaggggacgactactgagtttgaagttctttaaagtgttaaagttatttttcccctctcccacctcgttggcaacctctcacccaccgcttagcagcatgtctccgtacatgaccatacctcagcaatacttatacataagcaagatacgttccaagctgtctcagtgcgcccttactcgacaccaccacagagaacttgatctacgaaaaatggtgggccacgccaatatgctggacaggatcctcgacgaaatagacgaaatcgacagcgaggtagtactgtgtgacgctgccgatggttcttctactgcagaagctcattccgcttccccagcatccagcgactcttctcctctcactaataacatccggcccattagcattatgtgattagcatgcattttccccttttcctttcttaagaacatttttacgacgcggatctgcccgtcatcgcatacgaatgttgaatcacgccagaatcaccaaagaaaaaaactcgttcagttcctaggttttatgagccaggaacaatagacttttatcgcatattatttctatacgtgcacttatatatgcacacatatgtttatatacatatacatacatacgtgtttcttttcagcctgtgtttttgtcgggtccaaaaacatacaaggcaacataatattttgacataactcaacgcaacataacagtataaaacatagtttaataaaagagaaaaaaaaaacaatatttttaagctatcgctcttgccgca

SEQ ID NO: 215 - DNA, 1000 bp, Saccharomyces cerevisiae
cttcaggatatatcaaagtaaaaagcagctcctattaattcaaattattagctcaatcctatagcaacgtttctcaagtttaattgttttgaaggttttagaacctttttcacattatttagtccgtcgaaacatctactctttactatttatggctaaacaggctgaagggtatgatttcttttcttttctttattcatgtcgggtaagagaaggtcacttgacctatgatgtgggggcaaataataacgtgggaataacaagcgcgctactggtaagtgaaaaactaagataacagttgaatttcgtgtttagatgctatagagagtctggtacagcattggcgatttaagacttctctagtccacatttcttaaattcaaaatcacaagcgcctgttaacgatcattttataatctacgatgtgtaaatgcaaaaagtgctttcctccctctttagtttggacagggatagtgggtaaacgagtagcattatgagtgcatacattgccagaaagaaaccgcaaagcggcatatcttttttcttctttctgttgtaagggatgcttcgtcacgtaaaatggccgccggagtgagatgtcacagattacatcaaaaggtcggcgtatactggataagaaaatccgaacttttccggtgggctttaccagcagaaaagtggccgggcatgtattaaatatatcaccgtattttctgctggctttttcttatgcagagaacaaaggccagagtgccttcgaggaaattaaagggagcaatgtgatagatatgtcctgtgtcatttgcttcaatttttcctgccatttatttgtagttatatttatatctagatcaaccgaaactataccaacgacgaagctgcttcttagtaaatatattttctactgtgtcaacgcattggaactgacattgttcttatcctataagtcatacagttgaatttgttaattctttactagaagttgggattttcagcactt

SEQ ID NO: 216 - DNA, 1000 bp, Saccharomyces cerevisiae
ctgctcgtgaacgatggacgcggcctgcgctattcatcagggctactcaatcgcattatgtggtagacgagtatcttccgatcatcggcgcgttctttccacgctttgaaacacgtgacatcgatgcgggtcactgggtaaatgcggagaagcctggggaatgtgccgaaagcatcgtcgattttgtggagcggcacgaggattaaaggcaagcgccccggagcaaggtgccagtagcaccagtcggtggctgtgcgcttgccgtagcacatgacatacggactattgtgtgagtggtgatggggtgtaggcagtgccacaccagtttaaaggcctagtaacggcaaatcgccaaaagagatgatgctgatgcatacgataagatcgtcagtttcacgttcgcggttcgaacatggaattgtggctaaagaaatttgggcggtatgatgcaaatgaggtgtacgtatgtatatatagcaaagagtagaataaaatgagataaagcctcgttcgttctctccatttcttccctgtttctcctttattttctctactgcttatttcgagttcaccagagaacaagagagcaggaacgcaaagagtgtgtgacacgaaattcaagatacaaaaataaaagcttacgttgtgtatttcaactggtgtgctaagaatagagtttcataaagtactgcatttattcatatattatttttgttatttgtatatatacttcacacttagagttctactaaaagtctacccagcacgcatccttcgtttatttttacatctctcttttgcttttcctttttttttttggtgcttgctagatactactgaagatcaaaggttacaaagaacgccgcatatattttctgcaggcatattaaagaagttacaaaaggattaatcgaagcgctgtttggatacactcctgtaaagagaagaaaaggaaaaaaataaaaagtggacaataaataattattaaactgtcatagtt

SEQ ID NO: 217 - DNA, 1000 bp, Saccharomyces cerevisiae
gttcaaaaaggtttgtgtctcttagggagatcggctcaaaaccttttacaaatggcatcttctaaatttaaacttcgctatactgaactacagttgttgtatatatcaagtacgtacttttttgcatatgatgggcaagaatcaagcacagttcacaacccttatataggttcgagttgtcctacttacaacactgtgcttagtaatggttattgcgactttatccttgttctgaacggagttatatcaggaacgcaaactgcttactaaggagcccttctaaggagccctccgcaaataataggatcggcaatttcagacggaggacggagccgcctaagtgccaagaacattaaagaagaaagaaataaaccttgagcggctacacgaaacagtggtcaagagtagaatctctgaaacgtcgaaccctctttgtcagttatcgcgggcatattctgagaagaagcaatatacaacaaacgagcaggacagattaaaattttcaaggcgaggtaagctgtgccagatcagtgtgggacgacgctcagtagttggcgatcgaagcacgtgatcagttttccacatccgtgatttggcgcaaattaccatgtgagcgtgcgggaataagctcctttatttgcggagcgacaaaggaaacgagaccatattaccctaccttccttgttttattttacttttttttctaattttaattttcttcgttccttcaactgtatgtaccctttttctaccggaaataagacggtcgtagtgtccgcgtttttggttctttaacgacaagacatcagtgccttctcgcatttttgttgaattgtattgtattatgctcgatgtttccagaacgatatatacatctgagagtttatatatcaacgatcattttcttgttgcagtaagctataatagacgcgtcaaatagtctaaccagtctaaatctcatcagccacacacacgtacatcggaatattatagagaacaa

SEQ ID NO: 218 - DNA, 1000 bp, Saccharomyces cerevisiae
tctgactatacccgtctctgaaaactgtcgtttgggtacttcttgctctatagctacccatccgacagataaaaagtaccttattgcagattgcccttgctttataaacgacaatggttatatccaaatacaaaatgaaacttactttaccaacgatggggaatccttttacaatatcgaaccttccttgaaaaagaaagaagatgaccatataacaagttcaagctgcaactttgtcaaatctagcaaggattctgatattgagggtaacgacgcttcgatactatgtttgttctcgaaccatggttacgatagcgatcgtcacttaagtgccgcatatacacaattagccttaagtactgatggaggtaaaactttcaaaaaatttgatgagtttaatgataaaattatttatcaatacaagatattaaaatcacatataatcgtttcgacacaagatgatagatacaatgaaatgtcacccatggacatctggatatccaatgatgcgtctacttttcaaaaggcacgtctacctgctcaagtacggcacgtccatatgtatggaatttatgaagattctattggaagaataatcattcctatatctacgatattcacagatgaaaaaaacgaccaaccagctccctcagaaattttaatatcagattctcaagggttgaaatttttacctgttgaatggacaataaatcctcactttggttatattgatattgcttctcctcatttcttagaaggaacaataattggctcgtttcatccttcctttgactactctcataacaaaggaaaatataataaaaagatagccagatatgaaactaaaatatctgttgataacggcctcacatggtcaaatttgaaagtggttgacgaggaaaatgcagattcattcccttgtgatatcactaggcctgaaagatgttcgctccagaaccctttttatagtatctaaatctcaaatcctactgccggaatt

SEQ ID NO: 219 - DNA, 1000 bp, Saccharomyces cerevisiae
acaagaattaagttttacgtagtgtatagcggtaatgtttattaactctttcggcaaagtgcgtttgggctcgcaatgaacagacaccaccattgcttcttctgcgcttatttgcctttgttgtatatctagttctcaaaatggagtcattcatcagtcgatgtgtgggcggaaatgacgttcatctagcaatggcacactagtttttactcaacaattcaaactcaatggaaagccaggaagttagcgccgggaaacttcaggacaatataaaaacaggactaacggaagaaaataatgtgggcctttttgagcaacgctgacggtaagtagtttcctacgatcgtacaatcccggaaaattgtagtggtgcaagaagggaaaagaatgatggcgaaaaatgcacgcgcgtaaataatgatttgtcgagtcctattgaccacaaaacccgcggaaacctagttagcccaaaaggaaatggatagcatatgaaaaacgaaacgaaacgtccttttgcacggcagaaagagcttagtaggacccgggacaaatgcaagttagattccttgattcccgaatgctcggtcttgcgtttcgccgtggctgcatggaaggtcatcgtacgggtacgggcagtctggctgagtggtgccgccaaagtgcaatagctgtcagtagggcgtgaggaatgtaaaaggcaagaaaacatgtacgagggaagagaagggggcaaaagaaagataataggaacggtgtagatgaactagaaaaggttcaagagatgataaacgtgaagggagtgtcatatctaccgacataaagatagagatctttttttttcctttatttttttttttgatttttttttttgattttcttgatattagtttttagaagtcctttgacggggcagccggagaatatataccaacggcattctattgtctttttttcttccttccttgccaggcatctgcatccattattgcctttagttaca

SEQ ID NO: 220 - DNA, 1000 bp, Saccharomyces cerevisiae
ccctcttcgggaaaaaaagtcaagatttaacacgtggctacaccggctggcttacaaccaaccaacataagatcaaacaaccctcaagtttagaaaatgccttaatagcaacctctaaaaccatagacttctccattttcacgtgctaaaaaagttcgggtatgatgtcatacaaatcctttcaacaaaagatgcttcaagatcaatggcactcgagatcataaatccctgcagagcagcggctctgcatatagaataacaaacaaatcgtatttttcccgaagccaagaaaaaaaggagactataacctttcaagccagacggaaaactatctgcccaaggacaaactggcatgggctgcttcaatgttcggctaccttttttctcttttaacggggtttggtattttttttctttacttcataaacgaatgttaaacgactgtgaaaaagccatccctggattatgcgagagtactctcagggcacccgtccgtttaaagaccccaggccaaaataaaaatttcttgaaggaaaaaaatacacagggccttgaactgaatacaaagccatcttttttctcgtttgtcagcacgtcccagaaaaacgcgcagccgtagctcttgataagtggcttctgcgttttgcaacgcttttctgatctcatgttttcttatgctgcgggacatcattgtcgttgagaaaagtttcaatttcaaacgaactgcctaccgttgcattctccttggagaagggcctgagtttaggggaatcacgtctggctattacatgctacatcgtgcagtagctcctacatcgctaacaggcaaatcctacaccctctttaaatcgtttatcttttatatattatctggcctaaatttttacatataaatatttatcatattatgacagctcaaatgaatttccggcaccaagtcatatgagcactcgctactgttcgaagaacaaaaaatataaagcttctacaaaatttccag

SEQ ID NO: 221 - DNA, 1000 bp, Saccharomyces cerevisiae
tcagcagtggtgacctgactgatttatatcatactctgtggaatgacaatacttcatatcccttcttatgaaaacgcaaaagaaatagggaagcagagcataaccatagtaaatgggacacttataactcaagaatttaattgaccccctactcatactgaggaatgtggcgtcctcgtcattatatgttcgtaagctaattgggcgaaactttagtctgtcctttctgttcggtcttcacataagatcaacgatttcttcattaattttgggcgcgctgttcaaaaaggtcctggaatgcagctgttcagtagatattatatgtaattatagcctcaacaatttttcttggatcgattggatgagctattcacccatagaggctggattttccttagtttgagaatctgcgactccttcgcgtctgacatcggtcactacgctttctctattctgctgccgttgcgttactttgataaattcatttctttttttttgtaatacagaagaatttctggtaagtttttggcctgtgcgtgttcataagggaaagacattgcgcatataggaaaatgttagaagttcaacatcgataaaatgatattgtgtagaaacaccgattcccttttgtagatttctatatctttgggtatgacttctagtattatctgtatatctaatattatagtctctaacaacagtggaattgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtgtatattctgtatacctaatattatagcctttatcaaca

SEQ ID NO: 222 - DNA, 1000 bp, Saccharomyces cerevisiae
cactcatatcgggggtcttacttcccatcataaacacggaccaaagaattaaattcatcattcacataagcgaaaaaaagtaatcattattagttaacttccctttacatgtaaccataggaaaaaaaaaaaagaaagaaaaacaacgatctataaagtaaactaaatcggaacatacccttcaatgtatgacttgtcagccaaagaagcgtttaattgtttcaaagtttcaatcttggagaaatcggtggatgccattatgtgtgtatatattcggttggactcttcagtgctgaaaggtagaaagcatgaggtaaaaagataaagagtagaaggaaaaaaaaaagaaccaactaaatatagtgggtagataaccttaaactatttatttagaggcgacaatgtgaaaaattttttcttcaaaggctcggttgtcgacaaattgttacgttgtgctttgatttctaaagcgcttcttcacctgcaggttctgagccctaagaaaaaaaatttccttggttgaaaatggcggaaaaaaaaaattcagaaaaagaaataaagcacgtgtgcgcggtgtgtggatgatggtttcatcattgtcaacggcattttcgttcttgtggattgttgtaaactttccagaacattctagaaagaaagcacacggaacgtttagaagctgtcatttgcgttttttctccagattttagttgagaaagtaattaaattattcttctttttccagaacgttccatcggcggcaaaagggagagaaagaacccaaaaagaaggggggccatttagattagctgatcgtttcgaggacttcaaggttatataaggggtggattgatgtatcttcgagaagggattgagttgtagtttcgtttcccaattcttacttaagttgttttattttctctatttgtaagataagcacatcaaaagaaaagtaatcaagtattacaagaaacaaaaattcaagtaaataacagataat

SEQ ID NO: 223 - DNA, 1000 bp, Saccharomyces cerevisiae
gcttctgtcacttagtaagcaaatgtacgaaacccagagcattgtatgtacaccagcagtcgttttttgtagctcttttccatggatggacgatgatggcaagacgcgatcgtggcggagcctcactaagaaaaacaattgtggagaatctatacacacagaaatcgtacttcaagaaatattgattagcgagcctttaagcacagaacaatctctatagccaacatcttgtggaagctacaactgtttttcttgttcccgcttgagtagggccttacaaggcaagaccgtataaaataaagataactcctccgccgtatcctgaatttcgtgtgccctttctctctctctctcttcctctttcttcctttccctttccctcttcttcttatctcaacaaccgcccagcgcattagcaaaccacagtacgagctgtacggctgagccactgcacctgtctggcttgcccctttttgttgagtaaccgggtaataattcggctgtctaaacgatacaatcctcgttccacccacacccattcacccgtcgggcgaaatccaccctcgcggcctcgtttagaataccaggcaacggcaccagcaacggccccggtaactcgatcgcgttcatatatatcggatatactcttgaggcacaatttttttcggttttcggttttttctattattcttcgagatgcaaagcacacatttgagactcacaactcaagataccgcaagcacacagacgctattgttctcccaaagaataggttcctgcagtgctcttttaaggtttgaagatattgcacaaaattgtatctgatttcatctcatcgaacctcattccatcaacttccttttatcaaagcatcttgttttgttttcgcagaaaatttttcttccctttcaatttggccttttagtttttctccagtcgcaggcaagaaggtaaggaaatagaagaaaaagaaaaaaaaaaaaagggaacaataggttag

SEQ ID NO: 224 - DNA, 1000 bp, Saccharomyces cerevisiae
tgtgacgttaaccttcaaagccgcatcccttctcaacgattcagccttcggattcaacaattgcaatgacatgcttctactctacttatattataatcttctgcttctcactgcttccacacccttaacctttaccttttccacacactgcacacatacactgttatacataatcctttccgtctttcgttcgtttcttaccagaataacaactactaacacatcaccgagcgaaaattttgccaccaaagcaaaactcccgtaaacagtgatccacggcccgtatccattctgccgcagaacccacacctctcactctatcgaaaaacagcctactcccagggtccccaaaatgaaagctcactgcaatgggaaacgataatcacaacaagggaatgcaattaaagaaagatatacggtacacgaaagggagaagcgacggcgttaacctatttgcaaacgaccgagtcagacagctcaggtccagtcacgttaaagtgggttactttgagctgaggtgtgcggttgcggggcgtgggtgtgcgcgccgttgccatgcttaccgttctcgttgcgctcgttgctcgtattgcctcgtctgttcttgtctcgtagcttttttattatttgggttaatcgcgttgttgaacaagaaagtatgatagttgttgaaccggcccctcgtcccgttctatctttctacgggtgtcgtgtctattattttattgttttcctactaaggttctttgctattgttcttttaatttttggtttgtagctgactacacgtttcaaacccaatcttggcagcccggatcttcatcactcagcttttccctactttttttttttttcgtttcctttttcttcttttctttttctatttaagagagaagttggcgaacttgaagtacacatacacgctctccctcgcatcccggagctcgcaatcaaccactattactaatcacatcctaaattttgggaagcctacactacg

SEQ ID NO: 225 - DNA, 1000 bp, Saccharomyces cerevisiae
aattttgaggaggcattgagtgaaagctataatgggcaagctagccagaatagcacaaatgtgaatcgaaccgatacagcacaggagtttttcaaatatttgggtcattcatcaagatttgcggattcagactcagaagatgagtcccaatttttcaaccaaggcccatcaaaatacaacacagaaacagaaggcaataaaaccagcggtaacaaaaatagtaatggtggtaacggtgctttttcgcttttcaagagcaaaagtaagcaaaaggaaaataatgtggtttcccctggagtctcaagtcctaatcatactaccaccgatcctgccattacaagtaaaaaggtggacaagaaattcagcgggttatctttaagagctgccagtgaagctgaacctgcaaaaaattcaaacccttcgatgaccaataggttacgcttctctagtaatccagagaacggcgaaagcaggctcccacaagcacaggaagtcagcgttacaaaagaaaagaagggtagtttcggcaaaaaactgaaaaaaatctttggtagaaagaaatagggactctcggcagaaattctctccttgtacaagttatgtattttattctttttcgtgctcgttcaacttctgaacgatggcttccatgcactgtaacatataaaggattttttaataatgaataatcaagaaatctccattttatatgcttttttttttttgccgtttccactgcaatcaatggcgatataatcggatgaacaataaatattcgtgttcctattcgtgttcctatacgtgttcctagcagcaaacaataacagaagagaagcatttgattttcgtaaaaacttcaggtgtgggtgtttcttattaacggttaaactttacgaattgaatcccctatgtataatggtccataatacatcttaaaccaccaagccatcttcgtaattttgaactgggaaaattgggaaaactgcagacattcataatc

SEQ ID NO: 226 - DNA, 1003 bp, Saccharomyces cerevisiae
ggatgaaattgttactataatctcaatgttgtcagtacagaacgttttttatcgtccaaaagataggcaattggaagcagatagcaagaaggcaaagtttcatcatccatacggtgaccatttaacattattgaacgtttatactagatggcagcaggcaaattactcggagcagtattgcaaaacaaactttctgcattttagacatttgaaaagagcaagagatgttaaaagccaaattagcatgatatttaaaaagataggcttaaagttaataagctgtcatagtgatcctgatttaattcgtaaaactttcgtgtcagggttcttcatgaacgctgctaagcgagactcacaggtaggttataaaaccatcaatggtggtacagaggttggaatacatccctcgagttcattgtacggaaaagagtatgaatacgtaatgtatcatagtatcgtattaactagccgggaatacatgtcgcaggtaacatccattgagccccaatggcttctcgaagtagcgcctcatttttataaagctggagatgctgaaagccagtctaggaagaaagcgaaaatcattcctttgcataacaagtttgccaaggatcaaaattcatggagactaagctcaataaggcagtcaagggaaagggcattaggtatcaagaggtaacattgttagctttttatgcattataattatcgagttttatagacctatatttaattttttaacaactttatctctcttgagaatttttacatgaaaaaaatcacagagtaacgctaacctttctttaattgaaagctgccattgctcgtttagttacaaaacgcctttgaacttgccttcgacactttgttgcttcggagtcgcggagtattcaaaaaaagaaatagtataatagagagaacaatagagatattcgcgaagaacaccaattcaaacatatcgagtaaagtgcaattgagaacgccaaaaagagcttgtataatg

SEQ ID NO: 227 - DNA, 1000 bp, Saccharomyces cerevisiae
ctagaagtcaccacaatggtcaatctgacattggtgtcctcagtttcaatcagacggaacacaatgttcagaccaagattactattagtacccgttacgatagctactttcctgttcatcctatcctcctactttttctctttgctactttttttcgacacagatcatgtgcttgtttctcgtcctatcttttaaatacctgctcaattcaagatgccgttctttcgttaaacgaccataaataaaggcccacgtactatcggagataaaacaacgggtgtgcgaaaagtgccatttatctgttataactgctatatgcggatacataaacaacaaacacttatacaaagtgttcaatgaacctactccatagagtcttggccattctcctacctatatacttgcccagcaggggcagcaggacccagttgagcagcttgttcaactgttgcagcgactcttcccattgacgctgtgcatctgcgagctcgttgctgagtgacgtgtcctcgtcgctgaggtaaccatcttcttccaggccctccacgctgttgattgtgtcgatgccctgcaggatcacagaggtatcctcgctatctgccatgttctagttattgttgctcgtgcagtgatgtgctgtggtgctggggagtggtttgctctgccgatcttgcttgtaacggccggccgttaaatgggccttcggggtccaaacgaggcgcggtttcgtgaatcttgcttggctgtttttggcttgttaatcccaatttgcgatagtttacgtttccacggggcactgctcaacgggtttagttccgtggagcagatgtgttgcagatactagttgatatttatgttgatgttgatcattcttgtggcacaaaagtataaataaagcagcgtgctcttttttgtacgtggagtagtagaagtatattcgcaggtctttctctcattgttcaggacatatacatacgtaagcgtagttttcttcagtaga

SEQ ID NO: 228 - DNA, 1000 bp, Saccharomyces cerevisiae
aggtgaagagaaaaagcagagcaacaaccaggttgaaaagctggttgaagcacctgtagaatttgtcagagaaggtactcaattcttggccaagtgtaagaaacctgatttgaaggaatacaccaagattgtcaaggctgttggtattggttttattgcagtcggtatcattggttacgccatcaagttgattcatattccaatcagatacgttattgtttaaaagagataaaagacgagaaaaaataaaaacaacggcaccagaaccaaaaatcaaaattaagtagtattctttatgtgcatttttccctttaaattataacctttctatcggtatagtgtgtatatgttcagccctatataagaatttactctaaagaggtggaaggcaagagtcttgattcttcccatataatattactgcattttctgtattaaacatgttttctatttgccgaataagcataaacgtatcattgttcctttccctttatttaagctccataccgatcatggaaaagctctccaacgaccttgaaacgaaaaaccgttccttggcgatatgacgtttagctccttgtcaaattcttccgtgctaccacgttgctaccactgatatgaaacaagtacgatccctgaacggaacagcgcctaaaaatagatgggcactcacttttcctttttcgctgcctctttttcccatgcatttcctttttgagtagtacgtcttatttttgattatatgctcgacataccccaggtttcacaaaggtttggcttccttttagcactttctctctcaccctttcaacaagtttattgggcccgacttaccttgacgactttaatgggacgcctgctaaaagcttattctacataaatatatataccggcttcatataatataggaacaaaagaaaaagaaaactggaaaaagggaaggggctatctcattatccagataggccatattaggtgttaccacaaactgctgataata

SEQ ID NO: 229 - DNA, 1000 bp, Saccharomyces cerevisiae
ccgatgggaggtccatcggcatcaccaaatccgatgatgaatggctttgctgctgggtcaatgggtatgtacatgccatttcaacctcagccaatgttttatcacccatctatgcctcaaatgatgccagttatgggtagcaatggggctgaagaaggaggaggaaatatttcgccccatgtccctgcaggttttatggcagctggccctggcgctcctatgggtgccttcgggtatccaggagggatacccttccaaggaatgatgggatcaggtccatctggcatgccagcgaacgggtcggcaatgcacagtcatggccatagtagaaattaccatcaaactagccaccatggccaccataatagtagtaccagtggccataaatagtgaaggaagcacgtcagaaaaagcaatatatagtaataaattcatgcactttataaatatggtatataatcagtggtacttacttacccataaataatggaacttttaatttttatgggaaggatactggattttcatttttttcattttttttggaacagggtactgaaacttttctttttgaaaaaaaaataagaactgaagaatttcaatgaactggaaggctcatccattttttttttttttcttcagatagaacaggctttagcaaattttaagtaatcagtatttcaatcgccacaatctcaggctacattgaactctgtaggccaccgataaatattgcgggataatgagtaaacgaattcaacgagtttcctattttggtattctatattttttcatacacctaaacgatcgtaaacatttgttgtcaagatttacgtttcttcgaggtctgtgaaaatagagcaaattgttacttaaaagacaacaacaaatgtgtagggcaattctgcagtaacagcaatgtcattcctaatgcgtacaaacagtactgagactttcaaacgaataataacttcagcaataaaaattgtccaggttaatt

SEQ ID NO: 230 - DNA, 1000 bp, Saccharomyces cerevisiae
acgacgaattgcttaagcacagattgaatattgatgaagccttgagaaggctaggatccaagagaccaaaaaccaaaatggttagactattgtccgacgacgaatatgaagatgataacaataatgacagtactaataacgacaaggataaaaacgggaaggacaagaacagcccaaagaagaggagagaagataagtccaaagcatctaatgagagtcatgacttggagccacgttcaaagaagaagaaacctgctccacctactctacttccacacgaggaaaacattcaaaacgctgaaagagaagccaatgctactttgatcatcccaggccaggcaggtaggaaacaacaagaggaacgcaagcaaaaggaaaaagaagaggcagaggaggcaaaggcaaaagcagttgcagaacaagagaaagaggcaaaggcaaaagaaaagatagctgaacctgaacctgaacctgtacccacacttcaagctaaaaaagaagatattgtctccaacataaacgagtcaaaagatgcaaattctagtgacgaagaatttgctcaaagcttggaagctgaaatgaacaaggctgaagacgacataagtgaagaagaataatagtcctggaagttgagcttgcttatgtcaacgtcttccatccaacgagcttattagagaataaaaaaaaaaaaaaagaaataaaaatatatacttttctgtttgtcaaattcattttaacaattcatataatcaaatatgtgatttataataaccagacaaaagttaatcttgtacatttcagtataatatactatcaaaaaaaaatttgcgcttactaagcattttccccgtacaactagtacacagtgagaatggaagagggtaaaaattcattgttcggaaaaataatatattaaaggcaagccaaaaaaaaaaaatttagactaagaaaagaataaagatatctttgcaaggcagaaacccattcgatcagcacaaaa

SEQ ID NO: 231 - DNA, 1000 bp, Saccharomyces cerevisiae
tcacgattaataatgttggaataaaaatccactaccgtctatcaactagtagttatattatcaatatattatcatagacggtgttagatgatgatataaattatgagaagctgtcatcaaagttagaagaagctgaaatgcaaagattgataatatgataggataatgaaacatataaaatagaaagagggataatcgtaatattagtatgtaaaaatatacattccattttgaggattcctatgtcctcgtggagaacttttagtatattctgtttacctaatattataatcttttatcaacaatggaatcccaacaattatctcaaaattcacctatatctcaaataataaaccgatcggactgcgttcagtgaacctctcttatatagtataggaagatccaaatttattattcgctgatatgaccttttgacctttacatattaacgaggtgcttttaccaatgcatagacgagcagcttatcccataatgagtttaaattctattcaactcataacaacttatagttgctatagtcacaccttttcaacagataagtggttgtttggccgagcggtctaaggcgcctgattcaagaaatatcttgaccgcagttaactgtgggaatactcaggtatcgtaagatgcaagagttcgaatctcttagcaaccattatttttttctcgcgtattcctttgagggcgcccctttatgttgaaatattgagaagctacgaatcaaactttgaagtcagttgagtaagcaatatgaaaaacattggaaaatacaataaaacacaattacgaaaactatattgttttgaacagaaaaatagaaggaagtactaaaattactctttcaccacacaacaattttaactcaagaagataatcactgcttacttttatattttatagacaatttgcactttggggtatttttcttaattttatctgggtttttttcttctttttacaaagaaactatgctaagaat

SEQ ID NO: 232 - DNA, 1000 bp, Saccharomyces cerevisiae
actactgttctagtagcagttcccaaaagtttaaaatccgatttcgaaaaatcgtacgaaactttatccaagaacgttgtaccagcatctgccagcgtgattgcagaggatgctgagtatgttttgttcaatgttcatttgttcaagaaaaacgttcaagaattcacaacagctgctagagagaagaaattcattcctcgtgaatttaactactcggaggaattaattgaccagttgaaaaaagagcatgactctgctgccagtttagaacaatctttgcgcgtccagttggtaagattggccaagacagcttatgtcgatgtttttataaattggttccacatcaaggccttgagagtttacgtggaatctgttttgcgttacgggttgccacctcactttaacatcaagattatagctgtcccaccaaagaatctctctaaatgcaagtctgaattaattgatgcttttggatttcttggtggcaatgccttcatgaaggataaaaaagggaaaattaacaagcaagatacttctcttcaccaatatgcttctcttgtcgacacagagtatgaaccatttgtgatgtatataatcaatttataatcgatttataatactaacttagattaatatatatttctgttttttttttagaattttcaacttttttattcatagagataatacactgtgattgtgaatgtttgaatagtaatggaacataatccgataaaatatgcttttgatgaacgattagacatttttcaattttgtcgttgagttccaatccttccttatttatggttaacaaggaaagaggtggaagttaaaaaaatggaaattaaaaaaaaaaaaaaatcaaaaaaagaaaaataaaaatagaaaaattggcacggaaatctacaggatttagcactagtagggggtttattaagcactacaggtcgactttaaaccagaaaaaattatcattcagggtaggtgcaaacttgttaaa

SEQ ID NO: 233 - DNA, 1000 bp, Saccharomyces cerevisiae
gtgcctgcgttagtgcttgtctttaggtcaaacaggtcatcttgaccaacttagcttataataagaatgataatcgattactctaaatagcattctttcatttgcggcatcttataacccacacaccgcatttaggacccgttttttttctttttttttttgttgaaaaaattcaacagttcctatttttttcttttcattctttttttttgccttgccttcgtttcgagaattctttttctttttctttaggtaagggaccttctcagctgaggcacggtggggtttgtaatagtgtccattctggcacaaatgcataagtgatgctaaaatagtgatacgtctaaacaaaacggtttggatgcctagcaaatagtaaaaagacttgaatatatcacttttatcactatgtaaaaaaactgagttatattattaagttttttttgaaatgttcccgtttgacgtgtatttagtacagtatgttccgtggatactgtttaggtgcatttaagcgctccagaactctcctttaaattcctgcagcactccgtcagttgcttcgtaaatccgcctggataccgccttgaagattaaagttcccctcagtactcgtttagcttgaatccaccgcattatggcctggtaaattccctagttgcttttttctatacggcgtcgtccctggaaaaaaaaaacttgcctacagatcttagtagacaaatttaactacgtcaatctattgttctgcttaaaaaaaaagttgaaattgttaaatcctcaacaaacttatcgcttttcaagctgctgcaatcatagatcttacacttctacacagaatttttttttcctgtaaaaagaacgacaaaatatataaacctttgacaatctagctgcatttactcacattaagccttgagattttcatttacttcataatagcttgtagatgcgatgctgatacagtaaaataaaaattcagtaatacagtcaaattattgcg

SEQ ID NO: 234 - DNA, 1000 bp, Saccharomyces cerevisiae
tgcggtggggccccactgctcaacacaaggtagtacttcttattctttttagactctgggtcgtccaccacaagcccgccactgaaccctgccaccttggcagactgcagtatgtcgtccacctggtcgtcgtttttcgggtagaactgggccacaaatttccctcccttcttcagtgcagcatacaatgtgttgaaaaacctcatcaaccgctgtttaggatcgttgtatgaagtgtccgcattgcacagccattggatcgcactgatactaatagccgcgtcaaacgagcccgcccggaacggtatcccggtgcccatatcctgcaacatcaagtcgccctccagctctctactaagaccggtcgcaagcatgctgggcgatatatccaaaccacaccacacatggtctccctcctgcgtcaaaatctccccagacagtccggacccgcacccgatatccagaatgaaactgcacggctgcagattcaaaagctccaacgccctcagcgtcatcttcgcctggatatgctgcactctggtcgaacccgtgtacttgtgtgcttcgctatcattatagaaaatctccggtggtgccaactcctcaggacgtgacattatttcttctctgatatatttcctgtgtttccgtaccgcacctttttagcactacttttttactatgctcttcttcttctgcttcttctgcttttttcctctttatcacactatgtatgtgctgctcatctcttctttttatcgataaaattgaaaaatgtgagatggtgtagagtgaaaaaaaaaaaaaaatctggcttggccatcaaatacccggccgtggttggactcgtttagcgaacaatagcacccagcagaccctggcaacatgcggatgatataagaaggacgagcgtggtggaggaaaggggcgccattggcacactcacgcaggtggttgttcagcacggcttgcagcaagagcgccaaaacagattgcaaga

SEQ ID NO: 235 - DNA, 1000 bp, Saccharomyces cerevisiae
atttcaggaagcgatcaaaaagaaagcaatgttattcaacataactttattcatactgtagtaacaataacttcatatcaattaggattcactgttcattgacttatcactacaatatggaggaaacgttgcgtaatcgttgtcgctatagatattgtccctcccttcctctgtgatagttcttctttatataactttcacaaaagcttctgccctcatagttgccctcaataaacgaaaggccagatgcatacaggtgcagtagtacatccaaagaaacataggggcaaaaaccgtgttctaatattagactgcatatatccccttgtcattagcttaaatcatatagagtaatatgtacatacaggttattttatttgtagctttcctcctctttatggagcaaagtaagccatacgaacggtttacaatagagagcgtcgtttgcttacgtgattgtcatgtgccttcgtaggcaaaggggattgcacacctttttactaaacaatagaaaagtgagaattctcttataggcactgctgctcctcgtttctttttacgcgctgtcgttccaggtccttttttcgattaactacggtagtttcaaagagagtgcctgaagatcactccatatacaggctagatgaactgtaaacgagctcatcagcagcgtccctttcagtgtcactacagccacagcagcttacctcctgtacgatgtgacagagcaaaacacaaatgtgtgtcctttctactcttattttccaactcgaatataaagacggtgcctttgccttatttctaaggcactgaacagttctaaaagtaaagttttccctagccttagtaccgtttctgtgaagcagttattgaatagttattggacataaaaatccatattgaaaaaaaaaaaaacatacttgagaaggcattagctgaatagtaaagactgctgtaattcatctctcagtccttgcagtctgctttttctggaattaat

SEQ ID NO: 236 - DNA, 1000 bp, Saccharomyces cerevisiae
atgaactattatgattggcaaggctttttcttaattcaagtcacacgtcgaggtctcccttggaattcgtataaatcacactaaaagttctgtggattctattaaatgaaagcaacggttccgctttggatgcatagaaccttcgtgagtaattattttccaattggaggaatggatgttatcatcaaacgataacattcatagccaagaagtatttgggttttctttttgtcacatgtagactttgatacttctctgtgcaagctatgacaggttacaaagcgcattgagtggcgggctgcaaaaaaatgaggagatatttcaattaacaagatctagtttcctaatacggacctttttcggagcgctaggatcaaaattggatagcacaaacagcttctctctctctacgagctaagatcctctgaatggtgcttgcacattctcgtttgcagcatatttactccttttcgagtgtgctaaaccccaagtgacccagtgtctactgactgggaaaaagtgatctttctgtttggtagcgcgtatagcacgtagagtaaagttatgtgaatgtctattgaacgacgacatcaaattaactttttttgcagttctgtcacttaatcacagataataagagcagaacaatttaggcacggggaaattcgatcgatctgcccatccgtaggcgttttctccggagaagtttttacatgctgcgcatttctttggcggtgaaaaagacagtacatcgcgtgcctttaaagatgtcaaaaattatacgagatctgtttaagatctccatcgttcaggaactgtaaaacaagaagcattggcaaagatagtgattttgctccaatatattcgtttatacaacagctgtttggttcgaaagcctataaatggcctgtgtaaatggctgtattgagagtatgctcaaactgaaataagtaccagttcctgtcgaatctgcgatatccgaaaaactccgaagaaagca

SEQ ID NO: 237 - DNA, 1000 bp, Saccharomyces cerevisiae
ttgaaggtcaacatatggtcagctaaaggaggcacgttcagagacgagtatatcagcattatatcgaaggagagcgacgatttggacgatgtttctctaaaccatgacgagaggaggccatctagtggggaagcgcaccagttccaagcactcgggttcaaagtccaatggacgcctttgatagcttccactttcacataccatatcctgaacgtgaacatcccagatggacccgcccaatcggcagggctcatcccagatgaagactacattatcggctgccaagatggcctgttggccacgggaggggagacgcttttacaagatattgttagatcaagagcaaactacgatctggtcctttatgtctacaacaaagtttctgactgtgtgagaccaatcacagttcatataggtcccgacggcaggttgggttgcaacgttggatacgggtttcttcacaggattccaacagtaaagcactgtccacaacaagcacagcagcaggggcaagatgacaaccctgttcctgttcctgttccagtagaatctgagacggcttttgtgccatcagcattcacagcaccaccggtgccaacaaagaagaaatcaaaaaataaaaagggtacccagccattggcaatggatgactattttaatgaaggcagagataagtcatctaccgctgcgaagtcagcagaatctgacatcctcgccccaccaccacaaaaacagtcatcctctgattaactttcctggttagtcttttggttttgtttcatagcaaaattaaatatatatatataagcttgctttcccttcaaaacacgtaaacgatagttggcaatgtacgaaaagtaccgagactttttttcaaaggcacgcgtgtccttttttgttaagacaatagatattttagcattcagaaagtttcaatttccaagacttgacgtttcaattatatggcaatctcccaacaagcacccgctcatataatacc

SEQ ID NO: 238 - DNA, 1000 bp, Saccharomyces cerevisiae
ctgtgcttgctgttctaaccatacgtactactacgttgattggattataatgtcctttgggtattctccgattacgttgtcccatttttcttttttgccttgttgcgaagagcgttgttccgaaaaccgggtgcactttttgttcactttatatatcccacgaggagactgcgcgaacatgatatgtttgacctggcatagtgctattgttcataaacaataagccccctaaatacctgcatgtacgaaggtgtacgtacggtcattcgcatttccctagcattactttcagtactggacaggttatttttacccctctagtttgcgactaccactaaatgggccatttttacgtgtctacgacatatcgcaagggtttttttcttttgtcttattcgagtaattatataagcgcgcgtagtcatttttttagcgagaccctagggtcctgtagcagtaatttgaggttttcatggctcgaacaacgacaaaatattgaggaatcttgagccttattggggcgtaaatcacacaggtgttgaatgagcttggagcttgtgcggttatgtattagatatgggcagtttcctttaacgttggcgcctctttctttcctacccgtggggttgctctcgaaactgattaggtcatgagcatttttgctgagtctttttaggaagcagcatttttctcaaacgaaaaaaaaaaaaaccaaaaaaaaaaataaagacaaaaaaactatataatgctactggccttgaacttgcttggtagaagccttcttaattgcacccattagtttagcatctaccacatcttgattcgatgctcttcatttagaaatacttgtttatataaatatacttcacacggcatgaattaattgataggtaagtaagtttcttttatcataagtcaaacagtatcagatataagaagggaaaaggtagatatagaaacctaataagacccttattattaaacattcgttaatcaaatt

SEQ ID NO: 239 - DNA, 1000 bp, Saccharomyces cerevisiae
gaacggaactttagtagccttttgttctcaaaaaaatctgcgtcgcctagatcattaaacgttgaactttggaaatacattcaagaagcgcaattgagctgtaactatgagccgttaccataaagatagaaacatttattttgacttagaagctacaaggaggatcaactattaatatttttcctagagaacatttttaaaattggattcaataaattagcgccatctattgcccttacacttttctccttcatatctggctagaaaagggggggttacatctcggaatcaaatattttcctctgcgtcgagttttaatcctgcttctggttacattcttttttatcatacacgattctttgaacatcaacttctctcaaaaccatccgccttcagcggctacaattacgtaattgcaccaaggcattcgcggagaattcacgaatttgcagacgccaacagtatacgactcccaacacacgtctaatatcttgtacggatttcaagagatagaaatattacttccatggaagccgtttagagcagactgaatatgggcttagacaataagcttctgaacgagggtcttaaatctaaattcggattttctttttgaccgaaagcggaaacttcgcaggcgcgcaaaaggggttttcaaggcacctcggcacccctataattggcattctcacattctgcgcatacgaatacacatgagtgccataaaacagtactccacatacgaagtctatcaaagatgtatgattcgttcaaaaacaagaacatcttcatagtgataatgagattgtgtgaaagatgagatatggagaatatgtgaggtgctaaatgagcatctgttaacgaatcgtttaagtagtgataacagatggaggaacgggtataaatagagctgcttcaactatatgcctttgaggtatgcgctttcatttcactatttcttgttaagattacatcagcactaacaaacaaaacaaataca

SEQ ID NO: 240 - DNA, 1000 bp, Saccharomyces cerevisiae
tttgaaggactccaaggttgttaacttccacgttcaggttattcactacttattgggttttgccgtccattatgctccatctttcttaatgcaacgtcaaatgtttttgcatcactacttacctgcttattatttcggtattcttgcccttggccacgccttggacataatagtttcttatgttttccgcagcaagagacaaatgggctacgcggtagtgatcactttccttgctgcttctgtgtatttcttcaagagcttcagtccaattatttacggtacaccatggactcaagaattgtgtcaaaaatcgcagtggttgtctggttgggactacaattgtaacacatacttttcttcattagaagagtacaaaaaccaaaccttgactaaacgtgaatctcaacctgccgccactagtacagttgaagaaatcactatagaaggggacggtccgtcgtatgaagatctcatgaacgaggatggcaagaaaatctttaaagacacagaaggtaatgaactagatccagaagttgtcaaaaaaatgttggaagaggagggagctaacattttaaaagtagaaaaaagggctgttttggaataaatttcccagtactctccacatttttatgtaaagtcttctataagctctcgagcgtataattaaaaacgaaaatagacaaaaaaaacatcatgaataaaaaaaatgtcttgaagctgactatattgtccatctgcgtttagagacacgtattctatttcgctcaaataagtatgatctgcaagtagtttcagtggtattatcatttcgcaccgttttttttccaagaactcgtttacgtgccgcgaaaagtctatcgaataggcattcgagaacaatagaaaaggaacagaagcgtagtacatattatgcatagacccgtttcttttcttctttttcgaaaatattcttattgatttaacaattaagcaggtgtgtaagatcataactgctttaaag

SEQ ID NO: 241 - DNA, 1000 bp, Saccharomyces cerevisiae; identical to SEQ ID NO: 197

SEQ ID NO: 242 - DNA, 1000 bp, Saccharomyces cerevisiae
ataaactacctgccccattgctacaaagaactgatagatttgtgtatgaggatatcccaggtatactagataccgtcaaagatctatggggttctcaatttttcactggtaaaatttcaggagtatggagcgtgtattgtaccttcctattgtcatggtttcatgccttgatcactgccaggacccgattggttcctcatgggttttccaagaagtattactttaatgattgcgactttcaatttgcctcagtgtatttagagaatgtattagccaccaattctaccaacaacattccttgggcacaagtgcgagatcacatagctacgatcgtatacggaggaaagatcgatgaagagaaagaccttgaagtggtcgctaaactttgtgcgcacgtattctgcggctcggacaatttgcagatcgttcctggggtacgaatcccacagcctcttcttcaacaaagtgaagaagaggaacgggcaaggcttactgccatactgtctaatacgattgagcctgcagattcactcagttcatggcttcaattgccaagggaatctattttgaattacgaacgtcttcaggctaaagaggtggctagctcaactgaacaacttcttcaagaaatgtagccttttcaggtacgcgtgtcttgcttgtccgcggttttctcagtggacgtgcctattctgggttcctcttgtttgatgagactctgatatctacaatccaaaaaaatcggttgtaggaagatggcgtgcttctaattaaagtaacgtggggactcttatttagatacttcctaactacgagcacgtacgtctagaattcatgttatataacataatgatttttccttattttcttagtttttatcagccttgccttggcttccttctcaacatctagttgaattgataacatgacaaaaagaagttaggcagtggtagtcttcaaaaaaatatacaaaatagcaagcctgtaaaagaatttaatt

SEQ ID NO: 243 - DNA, 1000 bp, Saccharomyces cerevisiae; identical to SEQ ID NO: 238

SEQ ID NO: 244 - DNA, 1000 bp, Saccharomyces cerevisiae
cgcgtttttcctatttgggtacggagatatttatgttttgataagcaaatgcttcaattgtgccgtgcgcatcatcaatcccactcactgaggaactctataatgaaaaaaaaacaaacaggcaaaagcagatagaccaataattgatatctgatttttcacaaaaaatgcaggagagatcagcattaaacggatccatcacatccaccggacgaatccgtctcaaatatggcagccacgctggtgtgacacataatattactgcaacacttcttatctcattatttttatcatggtaaaagaagtcaacactatgcgaggaataccaaaagaaaatttggttcacatcatggtgtcagtaaaagcaaccgacaaaaatcggggggttgctgtccgacgtagtttcttcgttataattttcaataatcccacatttcgttgttaaccttttgcaaaaattgatgtagtttgttttcctcttggcccctgttgtggttaccgaacacgtgaatcgccattgcggttgtcaatatcagcccattgggttttatgaagattcgtaacaccttcgattatttaagtttattctcttatctacaataataatagcgttcttttacaattggacgctgttatcttacttctgaatgttcatggattggaaattttcaatcatttcacgaattattagcaatgaagataagtaacattaaaaaaaatattgatatcaacttgctaggtttcttctcgcttcaaaaaaatttataaatgggaatggaacactatcctgtgtaaacttaagtcatgtctcaagtcagttgttacttatattcattcctatcgaaacatcccaaaaaataatatttgaaacacttacaatcatacattgaacgtctaaacaacggcggcatttttttaatagcagaaacgaacatattagcttattctacaactagtagggtttgttatacgcaatattgctgttgaattattagaaatt

SEQ ID NO: 245 - DNA, 1000 bp, Saccharomyces cerevisiae
ttcccttttctttttctttgttgcgacagtggcttcaaagaactgctgattgctcaaggcaatcagtccgagcgtttagaaggtgattgtaggcagaaattaactttgcggtaaaagaatgacattctttcttaaaagaaaaattagcttttttttgtcaggcattgcacaaacttttttatttctgcctatactcttaaacagatcagtcattcatgttgtctttttaacggtcgtactgggacatcgcataccttgggattccgtaattaggtgcaacaatacgggcacaactcattctgcggtatcttcacggacagaacttctattgcctatcggtggtgtgattaacaattggaagcgcagagcttggaatggattttcaattcaatggatttggaggtattcgtttgtttactaatatttactttgaggacattgcccaaccctaaaagtgcctgctcaagaatagaataacattatgatacgttttcttgaccgctgagcaatttaaagcaactattagggtacgattgtttctagagaaatgtgggtcatctttttaggtccgttctcttctgatgaggtaacctttacaaaaatgtcatagagttaccaattgggattcaaggcatcatcgcaatatacttcgttcttttacggagaaattaagctctttctactttgaattaactgttagacttgtcttatctgaggaatgtccgtgttcgaattaaataaaaaattagggcagttttatttaccttaacaaatatgttcaagcatttacgttactgcgctctcttctagttcaagaacggataactcatagacttaccagtacaaattgttgaagggttcccaattgataaaaaggatctcttgcttcctaaaataaacgtataaaaagcaccctattcatcagttattatccctcgtcatgttgtggttctaattaaaatatacttttgtaggcctcaaaaatccatatacgcacact

SEQ ID NO: 246 - DNA, 1000 bp, Saccharomyces cerevisiae
gccctctcttcacatcttttgtgtcgaacctcgaacatcgagcatgcattgtccatttttgagccagtttctgcttattctcgtatttcaacaataatgttgttgcataatgtacgcacactttgtgcggcattttatagcttacagatacagatgaatttacgagctgtataaaagaactacaaggaagttgtaactgcaaaaaaatgtcaccgggacgatatcatcacaaatatggagggccgcaaaagtgaagatgaaaagaacgaagccgctttagcctgtgatgtctttgaatcctccaatgccaaactaccaaagaatgtattcagaagttcctttacttggtattgctatgaagttatcaataggtcagcattccatatttggttattgttatgtttaacgctcattgttggttggaaggttttttcaggcatcggtggtagaagaccatctgactcaaacatggacggcccccaaaccaaacataaacggaatccaggttttttgaggcgtcattcgaccatcgttatcttagttatatctttagcagtgtctttctcatgggaagctttcaaaatgtatcgtgaacgcaccttcgggaaacaaatcactcagtttgccaaagaaattattaaaagtgcgccaagcacagatatggaaagctgggaccgtgttgcagcggattttaactcttatatgtacgaaaataaactttggaacacagaatactttttttgttgatggttctagctgccatgtagcatttaggagaacccttctatggatttcctcaagaattgacggcgactataaaatagaatattttaggaaacacccttatattgaagaagcccttaaagtatattttgcagaagtggatagaaagtggaatttaaatacttctcagcaattgttaagcaatatttcggttggaaatatcaaacttcctggtcaatcatgtcgtttcaaattatttcatattttcaagaaagtc

SEQ ID NO: 247 - DNA, 1000 bp, Saccharomyces cerevisiae; identical to SEQ ID NO: 143

SEQ ID NO: 248 - DNA, 1000 bp, Saccharomyces cerevisiae
gctttgtccgcccaccccacgcttttggccactagtatgtacgtatatgcgtgggctctatatcattgaaaacgaattttccacgcaaaacccacttcacaccataaaggccttatgacgatgtacattcttcccctcccccctcctcccgaaggaacccttatagtgatcctaatacggtataacgtaaaccggagttgtcagcagagagaagcgaataatatgttttgcgtggggttcccacgagcggcaggaaccgtagcgcattgaaaaatgaatcatcgatcatctttgggtttcaagggttcggacttcgccaaaggtccgaatacttccaccagtatttctctttttccctttccagtctcgttcttcgccgaatccccgctttcccatcatgatcgtttctctgtttctctctttccggaacaggctcttttctgaccgccagttcgtgcggttagttctgtggatcttgcaggcacttgccggtttagccacacttctccgctgtttgtgtcgaatttccctcgagtatgagaaagactggaccacaaaagagggaaaaaaaatgggccgattttaaaccattataggtcacagaaaaactttcttacgacggtggtttttcaacaatacgtttcttgagcaggagaggagctttgttcttttgccttagttttttttgtctttttttgtgagccatcctgctgtcgttgccatacatgacagatccacatttgccttgttgtttttagtttttgttccttgcaccatataaaagcgtcacttgtattttccttactcatctaaacttcaagctttttcgtcatagtaggtttgtgatctcggcaaagaaaaaaaatttttttgccgatctttctggttattgtttcaggtatctttatgaaagtattagtgtacgcactggatttttggtaggtctataaaagtgcaacacataatctaaatcattgaggtcatcgtatgtcaaaagaag

SEQ ID NO: 249 - DNA, 1000 bp, Saccharomyces cerevisiae
gttttctggggcctttgtctattcgtatgcgcagaatgtgggaatgcctattataggggtgccagagtgccttataaaacccttttccgtgcctttgaagtttccgttttcggtcaaaaagaatatccgaattttagatttggaccctcgtacagattcttatgtttaagcccatattcaatttgctgtaaacagcctccaatggaagaggtaatactatattatccctctcctgatagtttaattaaaaatagaaaacgtgtattgggagtcgcttatttgtagagtttgtagtttttaagcgttctcaggaaattcattgacgcaattacgtaattgtaggccgctgagaagcagctagtattggaagagccgcgtatggtaaaaaaaaaatgttgagttcagtttgtagcagtactacaactctgtgcggtgggaaaaatttattcttcgaggcacagtatttttcttctagctagatataaagaaaagtgaaaaaggcaatatatggcgctaatgtattttattcaattaaaaactttctgtaggaaatggtattaatagttggtattccttgtagacaaaaccatcgctatattcatggtgacggctcatctctaaagcttcttaaatgtacagtcagctaagtgttctcataagaaagggtttgaagaagtctccgatagcgtgctttagtatgttgacgaaagaaatcaagatctagcttatatgtcataatgaagtaagttatattggagtttttctggtaaattctacaaaagttatgcaacatacttatttctgtcctcttcttactcgtcttgcggccaaaactcgaagaaaaacatacgggccaagaaaaatgatgcaatcctcccagttctagatattcccgcttttaagtcccgaattataacaatataaaaaggatatagaaaatgtaattgttaacttgtggtataaagacaaattcaaaagcaagtgagggcccgctaaggct

SEQ ID NO: 250 - DNA, 1000 bp, Saccharomyces cerevisiae
ctacatgaaattcagaatttatgacctctgactccttgggcatttttggtgtctatatttatattggcgatgtgatagaagaaaaggtgacgaaaagattgatcaacgaattgaagttctgctgatcttgaacaatatcgtattgttttatattattaggattaccaagagaaacagcaatgggtggcttcaaagggggcagggttctaagataagcctcaattattctcttcgcgctgcgttaaagcgggcgcttctccgaaagtacagcacgttctgaaaagcctcatcaacatagaatccatatgatgctcaacgactggaagtaaaaacatgaaaattgaaaaagaatatgcctgcaggagcattgggaagtacatagtggcttatagactgccaaaaaaaatcagtacggaagcaaatgaaccttatgttatccagggagcggtgagtaactgagtaaaaacattaggcaaatttcttccaaaaaatcattgacattgcctgtcaattgagtaaatgaataaataaataaatgcaaaaaagccaacctaactctcctgcaatgatacaatgagtactgtatcaacgaccattagtaagtatcatgaagtgttttgtatatttggaaaaaaccaggctgcattgccccagtggtgtatttatatctactgcagtatgttctattctgtgaagttcctaaaagacaccgaggtttctatggcctaaccatattgttgttctaacgccttttctatgtaagggtccttattgttcaaagccccaccgctccttcgcgcgttgtgcctatcattgtgtcagtaaatgttaggatacgggaagtgtatatattaattgagtggacacagaaaacgctctagaaaggaatatctcacaaagaactgtaatataagcctacattattgatttttttagttctcttgcccttatattaccgtaagtctgcggtataatcacctggcctagtgctttttcaatc

SEQ ID NO: 251 - DNA, 1000 bp, Saccharomyces cerevisiae
acgcagcttttgaatcgaggggtggatccaaaacctggggtagccagactttaaacaccctaaaactttggggtctttctccacatacgaaattacagatttccatgtcgggaaacatacagataccgcatgttgagtgtccagtggtataggctgtcctagctcggtagccacttgcgctgaaaccatattataatgtcctatagaagaagaaaatgtcaggaaaacttcgcctatagcccttactctctgcgtggccctgctatacttctttcactattgagaggcaattttttcatcaaattttcattgcgaattttccagacggcatcgcacaggtagtcgggtaacacgaagatgtggtttttcaacttggtaaggactgctattaaagaggtcagtcgatacaacgagagaaacttaaacttacacgtctatccttggcgtccatgttgagcatggtattatcttcacctgctgcctgtctttaaatcgagggtatccgcaccgcagttcgtgacctgtgcctgcgttatgcgagagcaaaagggcccttaacgagccggcacctaaacgaaaatttcaagggtttttttggcggtgcctaataaggaacgcgcagaacaatagaccctgccggtaaacgatggccttgcagtcgtatactgttaaaactgttgagtgggtgaatggcagggcctaactgcttgcctaggagtaccgcaggaacggtacgaatcgagtggagacagcaaaccttgacgtgtgcttgcttttaaacgggtcggagaatttactcttgagcatatacgtgtgggcatatgcatacaaatatataaatacattcgggtgtatacgtaaatatataaatatataaagtaacatatgtatataaagacgaaagattgaacgccatcgtggagagggttttcgtatgaaggtgccttaagtcttgtgtagaagtagttctttagttaagatagaacctggtaaagactca

SEQ ID NO: 252 - DNA, 1000 bp, Saccharomyces cerevisiae
taaactgcacagaaaaaaaattcttccacaagtttcctcttttgccttttagtgctaaaactccgattatagaaacatctggcttcactagcatattcatgatgcaaatggaacacagtatcgttcttggcatatattacccatatcacttttcaataacgctggtgtttcaggtgataactcatcaaactcgcattcctcaagagggagttattataacaattctatcttattcctgataaactttcatagattcattattcactgcatcacatacatttttgctttggagttcttaatcaactttctatgtgaagcgtaaaatcaatagttaccttgtattctctgttgatcactgtccaaacctatatttttgtttccccctcagagaagttaggtcgatgcctatcgtagtttgcaaggaagacggcttccaactgagaccgccctagtctggcaggattcgtgaaaggagtccatgccagctgctacccagggattgccacggccccggccagcgtatagtacactgtcaggagcaattcgaagaggcaaccaaaattatgctaagcatcgcactctctctcagtctggtgctaagcggaagacatgcttccaatggcctcctcaccgagaacggatattaaacgaaacgaagaaaaaaaatcttcacggaaaatgcgtaatgtctggatgacaaaatgcatgggtgtaaaaaaggaaatgagacgaacttgtaataaaccttagtgggttgacgaattttgaaataaagtttttcctttttttttttttttttctttttcattgtttggttgccttcaaattacatataagatttctcgagaagggttttccattgtccttttcattaggcgttgaagtgaatctaaagtgcgcttgaatgatttcagatagaaagactaaagaagtggtgtgagtataattaactcaattgaagacggtttacctgaagtgatatactgtgccttgagaaaca

SEQ ID NO: 253 - DNA, 1000 bp, Saccharomyces cerevisiae; identical to SEQ ID NO: 242

SEQ ID NO: 254 - DNA, 1000 bp, Saccharomyces cerevisiae
atagttcagacatagctcagaaaaataataataagtattatcaaatataactcatctggttacatgctaagttcttgtcaagtgatatagcgttatctttattattgaattaaattctataattagaattcgactacaccaactaatgactctaaaaaatatgtgattgcccttcaagattgcattatttctcaatgcattacatacatagagtatactagatacagatagatgattgtaagtgttggaacaagattcaattatcatcctatttattgcgatagacgcactacttgagagtgatatacttacttatgctactgcattcaaagagtaccactaaacaatctcaacagaatcaatcagacttttttttgccacaaaaacttttaacgatgtcctttggcagtactgtattttgagattaaaggcgttcagtcaataaaaaatctaaattcttgttcattttcagttctggtatttttttcatattaatgatggggtggctctggaggctcatttttcccactgaagatcgctggtaatttcgttcgtatgttttaaagagaactatatcctgtcgccaattatgtgcagttgatgagaaaactaagatagaaataagtagggatggaaccaggatccacaagaagcgcgtttagccgatccggcttatcaggtacgagaagcagtattattaagtaagaaagcgcgcaggaaagcggccttttgaaagcacgtctgcagacatctcacgacacattcccaaatagggccctgctaaaaaaaaagcagcagagcgtacgttgcctgggaagcatggtttagcgtgttgctatattatggtaaggggggtggtcagtatacgttgtgctgactgccagagaatatccttattcacaattatttgttgagtttgatacttatttacagagactatatataatgacacttttggaatacagtatcgctactcaatatcataaaaaaagtaacaata

SEQ ID NO: 255 - DNA, 1000 bp, Saccharomyces cerevisiae
ctgaaagagcgcctttacctcaacctaccatggcaaacataacagaaaacataaaaaaattatcctagagcccaatgttccatgaaaagagctgtggcaaggacagaaacaaaaaaaaaatcaagaactcaacattacctatataatttttgttttctcccattttcaaagtcatttgttttccattttgcaaagcaattattatatcaataagccttttgatgactttacctagcactctttcaaatagaatcttcttacgaaggtgtgcattctcccttttatacctcggcggcttcactcggcggctaaccccttatttcctcatttcctcggcggctaaaaagggactttggagaaatcttgcatccgtgcctcccacggcatttttttttggtttctttttttccttgaccggcataatagaagaaaaaaaaaagcgcgccgttcttcagtgccgcttgagggtgccgtctaagcggcactgatctgctgcaaaaagctgcaactttgccgttgatggcactcccagtggcaccatcgcactaaataacggtctcatcgagtcatagataagcaggttgcagtatccggccaactttcaactcccccacgtccagcggattgctgctccttagtagtccacagttcttaagttgcgctgcgaggctctttttttagtgccttctagccatttcttccagcttggcagtggttatctctttcactgaaccgcaaatcaatcctgataagacggctaagatgcataggataggtcggctatacgtgtgtcttgcgctatcttcccctcgtccgctaacaagactcatatccttcgtgattagtttctttttgttattttcctcgtaatactcatttgttttacatacatatataagtgctttgtctttgatggtctgcccacaacaatgtagaacaagtttattatgtaatctttatagaagaagcacgctaatatagacaaagatagcttcgcaca

SEQ ID NO: 256 - DNA, 1000 bp, Saccharomyces cerevisiae
atgcttttcaccaggttggtatccatttttcatgagctctcttatcaattatgtaagtgcttgtatactatttacctaagataagaaaaaaaaaagcaattcaaaattaagcttatcttgacagcggggctggtttgtttctagaagacaaaaagtggggaatcatttttacgtaactccccctgataagaaggactcacatccttataggtacgataaagaatggttgtatctttcctatttttcgaaatcgttatcttatatagttgaactactacggttaaaaagcttaagcctcagccctcttagtcaaacttcttttttgaaggcaccagggtgcataaaagtgcgtctattgtttcccagtggaactctgttgagatagcgatgtttgtttttttttcacttaacggcaaccaataccgatagcgacgtcgctggcagtgtagagtggccgtacggcgtcgctagatggcacggcactgattgcggcgggagtcgctaggcggtgatgcatttccgcacagggaccagaggaagcttcccaggcggtgacagtaagtgaactcattatcatgtcttctccaaaacattcgtgacatctagtcatgctcctcgcaattcactccgattggtatagctttttcggtagttttagctactatgcttaggggaaagaggagaaaccgtaccgtcagtctcagtcaaaaaattttgatattcaatctgatagcaaagttggaacttggggttatctggcccttttttgttatcatattcgtatacccaacaacatatcggttccaccggtcctttttatatataaaagacgatgtgtagatgcactcgagtattcttggagaacgtaacttgtattgagctagagtgctggataaagtaccacatactaacgttcttttatagagccaaacataattcttttgcactttcaatataaggtacaagtgaaacacaggaaaaaaagaactaactctaagta

SEQ ID NO: 257 - DNA, 1000 bp, Saccharomyces cerevisiae
aagctcaaaaaataacccaatgctgcatcgatttttggagaaagggggtcaatcatcatctatcttcataaataacgagttgcagaaaaattggaaactggttgattttgaaaagttttcatttttctggcaacaaattatagctacaaaaaaagaagttatggcgcataagatgcatcaatatatggtgtgaccagattggacgtaactagtactcatgttattattcatatccttcatttttccttcttttcttctccttctcgaacagtaacttcagattgaaagacgtgaggatgctttagaatgcacattaaaattaatatactactggcctcttgtgtttgtcattggcttctattttcaataaaacatccagacaaccctgctgttaattttggaaaaaaaatttcgccgattctaatcatgtgactccttttccccaggcaataccggagaaagcgttctatctcaaactatataatttgcgctgctcgtctccaagcccatgctagtgtttactttcggttgtaaaaggtaactagaagttttaacgcaagcattgtattatattttcccacaattgctcttaaggacctttttttttcttgcgtgatcctgcactattgaaaagtctttatcaaaaatagatgaaactttttcagggttcaacatttagaggcttttctcatattctttactcagttgcctgcgaagacccttctgcccgctgcgcattttcttagaaaatcaaaaaaattgccttttcatcttttaccttccgagttgaatatgttgactatttgcaaacaggcgtatgattgtcgtatataacagggcactttcggcagtgaatcaataggaggcgtataagaaaagccaattagtacctatatatatatatatatatatatatatatatatatattcctttattataattcctatcagcgatttttgcatcacacccaagaaaaatctataatagagacacaaaaaa

SEQ ID NO: 258 - DNA, 1000 bp, Saccharomyces cerevisiae
attctcccctgccggtaaagaccggcgcacgcggaaaaggcgtacatagcgtcgggcggtaacggagtcattccatcgctgataattaccccttgcagcaaacccagagccctattacgaatctagcccatacaccgcgttagagcactcgccgttttgctccgggtcgtgccgtcgtacatgcatacgcgtcctgcaggcataccataagcccacatacaatcacctgtagaaagaaacaaagcttgtgtatgtaatcaaagcagaaatctgatgggttcgaacgacttcgttatagaaatattatctttgggtctcgtcctgcgttattcctcctgtctcctgccgctttgataaccttttcattcctccccttaacttgttatttcgtgttacgatattgggtaacttagtagcgtaaatggtaaaatgtagggactcaatctcataggtggttatgtttttcgttctcatttttcaaatctgtgacttcacagacaaaacgcgtagtgatttctttatctgaatgagccttcgaaaaaaaaaacaacgatttcttatgcagttagtcggccagttggttattgactatctgtgcgattccccttcctgcataaaaataaacacaatcttaatacgccatacgttgactccattttttgctcgtttcattatattatcttcccatgccgctcctgcgtgggattccctttattataacttttaaggtttctacccacatatatgcaatttttatcatgtttttctcttttttttttttttttttttttttctctctttgttgtgttttcgagaaaaagttcaattgtttaaaaggaattaagcaaattatatatatgcgactgttggtttccagttctaatctgtactcttttttttgaatttgcactgttatctccttttatacttgcgtgttaatcttgtattaggcaaaagcttagtcgtaatatatagagattataaaaccaaaataaagcta

SEQ ID NO: 259-267 - skipped (9 entries)

SEQ ID NO: 268 - DNA, 1000 bp, Saccharomyces cerevisiae
gtagtccaaggaatatacaaatagaagcgacaaaccaccagccgctccaccagagaaaagatttccagcaaaccacttggcatacccatcgcgctctctgtcgtaactcaacaacgacttaattttgtctttgaaggcaaaattcagcgcctgcgtggggaaataccggagaacattggcggtgttacccctccagaacgacacaataccttcatgagtcgcagtcctcttgaagcaatctaaaattcccttgtaccgtgtatccaacgagccctgtttaagcatctcttcttgattctgcatcaacagtttcacccgttcaatgggagcggcacccgtcttcgcaatggcagcagaaacgccgcccataaggaagtccacaccgaagtgtgactgctgagtctgtgtttctgtgtgagacattactgctgtaaaaaggaaaaatagaaaagaataacagatacgagaatctgtgctgccttctttgcgataatgccttggcttgcctatttcacggttacaggaataataacatgttcataccgtttcaggaccaataaatggtcttctgcgagagaaaaaggacactctccgtccgacagaaataagctttactttccgggtgcgaatcagcccgttgcgcctggggtggtccctacagtacgctgagtcgccgataaagaccctccgcctagagctaggcgaggctgacttaggcaggcccaacaggcaaggcccatcttcaaaagtgcacccatttgcaggtgctcttattctcgccaattgcgacagaaaatgaaggatgcactcaaacagtcgatccttcgagggagtatgccaaggcctcgtgcatgtagtgcgattatatatatatatatatatatatatatatgtatgtaagcaggccatgccctatagctcttgttctataagcgatggataggcataggaaacgaagaggaccccagtgtaaggaagagtagcaaaaaattagaactag

SEQ ID NO: 269 - DNA, 1001 bp, Saccharomyces cerevisiae
gagtcctcgagtcgttcgccgtggcatctctcacaagcacttgtgtggatgagtagcccttcatcatgttctttgcagaacgaacaaactgcttagacattacttacaaaacaaatacacttaataggggtgtgtcaaaataaacaaaagaagatgataagaatttgtgaaggtcaaactagaatgtgagcgtattcgcagttgtaggcaaaacagaacaaaataattaaataaacgaacgcctccttcaacaaaggtcaataatgtagcaaaatattgggagtgtgtcaatccttgaaagggtccgtaactaaactcttctttctttagtttccactactttttttttcacccttcgccgcagggtaatttcttgtaggccatgtatatacgattaatcgttacacataaaatgcggtttggacaaacaatacaatggatcgtgcgggatactgccagactacgctatgctcgactgtagaatactgagtggtgatatcgccccttcggtattgtgatcttgggcgcacttgtttatctaacaggtgcgggtgcaagtttactagagcatcgtcgtatgatggggaaagtcagggtgtatgtgcccgtcgattgagcaccaagacccgttgccatgtgcatatgttattgtacccatagaggcagtccacgttcggccatctatctatctttagataaacggatcattggcgataccgcctggccatttgcacctgctcggggtcggcgttatcggaccgtggaatttgagccatgtaacacacggtttcaaacatgggctaatgaccttcataagtaggacgatttacacctgagttgggtgtgatggagcaatggccaggtgcccctctcgccctcttgtgtttgtatataagagcaacctcctcatactctcttgcttagtctaaggaggagctatttaacagtgcacaatataacacagcatatatacacacacacacataaaataaccgcaaaaa

SEQ ID NO: 270 - DNA, 1000 bp, Saccharomyces cerevisiae
aaatcgtagccaccatccatgaaggacgctgaagtctctctctctaaaattactccatttgcataccagaatgcattacctatctggaatgggaaacatacagtcgtagaacccccatttttcaacatatatacatgcgcaatatcagagagaactaccacaaaacaatctggtgtcttttcaaaatcaatgtacccagctttgatgatcttttgattataagtaaactgacgtaagcactggtcttcaatacaccatttaacactccttccgtcccttgacaaccaaatatctccatttataccacctattttgtttgtgatattaatctgcaactgccattcgggagaatcaccagtatattcgccattgtgagtttcccttggtaaataatcatttctagtagacggcttagaagtcataagttataacgctagaaactaaagaaaggaaaaacagattaaaacgctgctataacacactgattatcgataagcaatattctagctcactttgtcaccgtgaatttgtcagcaagcaccaaaaatgtcgatgctttcaatgactattacgtatcttctctacttttgtgcaaatgtaaatactaaatgaaagccctattttgtgtagggtttacaccgcacaaagtaaaaagaagcgataaaaatgaaaaaaagtagtcaaaatacatactatcaaagtaagggcattggtgaaatactgcgaggctggccttttccgcaaatatctggggcagcgaagcgaaggggcccgataggaacttttggggcgggagcccttgcattgacatggttaaggttttacatccatcattctccccctctcttgtggtttaaaaaaataaaaggtggccgatttttatgtaatatagaaacgacttctgtccttctgtcctctgtattacctaattttctttctcttgatggtatttaactttctaagcattataagataatattaaagggaaagtgtttctaga

SEQ ID NO: 271 - DNA, 1000 bp, Saccharomyces cerevisiae
agggtgtaaagtgcgtgtggtggcgttctttccaaaaatattatcgtctttcctttttttttctttttttttttttcaatagtaatagtatttcctagtgatctcggcgattttccttgatttctccaaaagcgtttttacccggacgatatgaatccatctattaaacatcataacatcatattatttttttctgtgcttctaaaacggagatcaaataccgggcccgcgcgcgatggccggatgtccgtccatactgcaatgtgaattcccgcgcggttcaaatcttgtcacaagtttgtcaaaattgcttgtcatgtctgccaaatctccagggtcctaaatctgaggtagcacggcacggcacaagatggtacccatggtgcgtgacgacagccgctacttgcacggctttgttccggcagcccgggtacccgcgctgcgagttgaaacatcatcaaaccaaaagggaagcgacgttagtttttttcattgcgctagctatgacgtttgggtggcctagccggttcgcgtgtgcctgtcgcttttgtcgcttttcaacttctgcccgatatttcctatcaaaggaaaatgggacgttttcaacccctcgctatcatcgtgcctgcactctgcctatcgccaactacaccggggttttatctgcttcacccctccatccagtgctgataacaagaagaaccttgcagggtagggcaggacctacggccaaaatactaattatgtctgtttatgtacatgccccaatctgaatattccatgaatgtaggcacagcatatctccatccatgtactgatacagacgcataaacatatatgtatatacatacttatacactcgaatatttgtagactgatgtacttctatatatatatagggggtttgtgttcctcttcctttcctttttttttctctcttcccttccagtttcttttattctttgctgtttcgaagaatcacaccatcaatgaataaatc

SEQ ID NO: 272 - DNA, 1000 bp, Saccharomyces cerevisiae
cttgatattctctagcgaagagttgaaattttttgtcactgacttctgtatctctagttccttcttatgctgctttaagaaatgaatctgatcatcgaccagatcattaatataagtcgctaccagcaacagatccctacaggccctttccataccaggctcatcctcttcattcttgaataagtcgattgtttgcatcagtcgaagagatcttattagttcacatggtaaatgatccaaagtgctaaggaaactgtacctgatatccgaatccgagttttcgttggcgagatgttccattgctgtagacgaaaaaaacttccttgtaaagcggatgtgctagcgcatcatacatttcagttctattaagactttcacagatgctgttgtgatgttctgtgagccaatcccaaatgtttgtataaggacggaaataagacggagcgccacgtgactgaagattttttttttctcggatttcttggtaatgggcggccggtatttccggcggccaaaaaatgcgaggatttggttggtggagagggtcgagcgcctttaccctgcgtagatactaagggggctctttctagtatataaacaatttgaataataacgaggttagacgtccaactggatccatagactatctaagcttttagtagaggccattcgttttcttattaatcatcggtttcacaatctttctttgttaagcaacattttatacatttttgtactttatcttcaaatattaaggacaagaaagaaaaagaaaaagaatccatattctatattagtgtaacactatttttcttaaatattttttccagtactcccccagtttgataaaaagcattcattgaatttccccacatttgtgatatcttcaattgattagtttgaactagttctgaaaaataatattttacaatttgcattttcattacactatatcatctactattttttctcagaagcggaagttataactaatttgaca

SEQ ID NO: 273 - DNA, 1000 bp, Saccharomyces cerevisiae
ttgcttttccagagtttacttgcactaccacaatttagatcaagtaatcgtgggattcagcgtgggggcactgactggatcactttatttttttatagttggcatcataagagagcttggtttaatcaattggtttttaaaactacgtattgtcagattattttacatgacagattcttacaatctggcgcctttgacattgaaagagaattacgaggcgtattggaaaagaataaatcagcgatctttcaatgataaatccaaaagggattaggttgaacatttcatttttcttattttttcatctattttagcgaggcgatcttgagcgtttgtgtaactggataaaacttggcaagctggagtagtccttatttctcataaagaaagccgaaagcctgctctcctacagttattaattaagaacgctcgttttaaacagttactgtgtaaagcgacggtaatcgaaaaagtatgtgacatcgtgcaaaagaagataatcaaaaccatgcagaacgtagaataaatgtgagttctatcacttgcggagataataccctctgacgccgcggggccgattgttccacggagggaaagaatcggccctcgggttttacgagagcgccgcgggtgaactcacttttttctcgagaagaagtttcctacggcagaataagacccttttccacggataatcagcggagcttctggacataatagatggtttgtgaaaaagcttaaggaaagccgcggatttagcatgtcacccacacttagattacgaaagcaaggattgcagaaaaaaagatgagatacagttttgagggcaatatataaaatatataaatatagcaacattcccttctctctgttatgtccacaatacttctaaaagttgtaacatatatctatacataaaaacttgtaacaaacatataattaaaacaactagtgacaagacggaagttataagttatcttctctacagaaacaatacgta

SEQ ID NO: 274 - DNA, 1000 bp, Saccharomyces cerevisiae
gctaaccgcattagagaacttgcccatcgtttgcgacacgatcactgaccgcgatgcggaagttctggagtacctgcaagatattggtctggaatacttgacggatggtagacccggtttcaagctgttgttcagatttgattcttccgccaacccattcttcaccaacgacattctgtgcaagacctacttctaccagaaggagctcggttactccggggactttatctacgaccacgcagaaggctgcgagatcagttggaaggacaacgcccacaacgtcactgtggacctagaaatgcgcaagcagagaaacaagaccaccaagcaggtgaggaccatcgagaagatcactcccatagaatcctttttcaacttcttcgaccctcccaagatccaaaacgaagaccaagacgaggagttggaggaagacctcgaggaacgtctagctttagactactccatcggggaacaacttaaggacaagctaattcctagagccgtggactggtttaccggcgcagccttggaattcgagttcgaggaggacgaagaagaagcggacgaggacgaagacgaagaagaagatgatgatcacggcttggaggatgacgacggggaatctgccgaagagcaagacgattttgctggcaggccggaacaggctcctgaatgcaagcagtcataatcccaacgcacttcgcaagagtggtcataaccgtattcatatatttatatacatatgtatacatacatatatagatatatatatgtatatacatgtaagtgtgtaagctgaaatatatgttaaagcgcatgtaactaagacgacaataataataataataatgataataatagcctagattttctccgccgtgggggatgatcgtattctttcggatttaataatatagcagcaagggttataaaaggaaagataacggaatgtatcggtaatcattaaccatcactcactctccagaaccgtagcgtaatt

SEQ ID NO: 275 - DNA, 1000 bp, Saccharomyces cerevisiae
gtttatgaagagcaaaactggaaccagccacactggtactaaaaaaatcgacaaaaagcaaccttcaaaattacagcagcagcatcagcagcagtattggaataatatggatatggggagtggtaagtattatgctgaggccaagcagaatcctatgaatcaaaaacatactccctttgaatccaaacagcaacaaaaacaacaattccaaacactaaataacctatattttgctcagtaaagcgttaaataatccttttaaacattaatagcattgcataaaaaagatggtcataaaaaagactgcagcgggaagtaaatggtttcctggtctgtattagacaaactttggaatagagaaggatatggtttatgtccaataattattatccgagtccgtgtatttttttacatcaactggaacaatttattacccggatgtttaaaaattgttgtcgcctggagaaagctaatactagttctggccatattttcaaccattaaacactactaatgtaattacttgacttatttgctcccactcttggtcggttctttcccatggcgcattctaccattctttttttctactccaatcgttcttactggaaactgtgggaatagcgaagaacgactattatttgctaatacagagtaagctatcctgctgaataggtagacgatagtagtaacccaacgccgctatcctttcgattataccgctatgaatgtagtgatatggtgcggtattgacacaatatagtaatttcgggtaattttttttcccaccaatgagaggcggtactgggagtatcggtctaagagaatcgaaaaataacccccagctgggatgtgatcacgatgagtgacgggatacattaaatataacaaacatacacgttgccttgaacgttttcactacacatcgcatgtgttttatctagatttaaaatcatattactacagttctacagttatacaaataacaaacaatagaaaa

SEQ ID NO: 276 - DNA, 1000 bp, Saccharomyces cerevisiae
tttatttctggtacctatgatgcaattgaaggtacaattaaggattacgatggtaaggaatactaccaaattagtggtaagtggaatgatattatgtatatcaaagatttgagggaaaaaagctctaaaaagactgttctcttcgatactcatcagcattttcctctagctcctaaagtccgcccattggaggaacagggagaatacgaatcgagaaggctttggaagaaggttacggatgcgctggctgtacgtgaccatgaagtagctacagaagaaaagtttcagatagaaaaccgccaaagagagctggccaaaaagagggccgaagacggcgttgaatttcattcaaaactatttagaagggcagagccaggtgaggatttagattattatatttacaagcacatccctgaagggaccgacaagcatgaagaacagatcaggagcattttggaaactgccccgattttaccaggacagacattcactgaaaaattttctattccggcttataaaaagcatggaatccaaaagaattaggcttctcattctattttaattatactagtacgatttctcactctgtaatttaatatcagtgtaatatgcacctagttatgggtagtttttgctaacgttacgagccgcgaaactgtcctcaatcttcaccactacctctaatgactgaagaatgctatgcgatataacgctgtcgcactttgaatatatacttatatttacatagttttcaagtgcgtattactattgcaaagtagtattttgtcacgtgattttgatccaattaaaactaaatatggttcaacccgttgtttccgcatcaaaaaaccataccatttatcaaggggacgggatatatcacataacagtttgaatgcataatttgttatagatatcttctggaataatcttcacagcaaaagcgcaagtcgaataatatatcgataaatacaatccataagacttaaaactaacctca

SEQ ID NO: 277 - DNA, 1000 bp, Saccharomyces cerevisiae
gcgaaagcatattcttggcagacagcgatttcgcgttggctgattgtattcgcgtcttaagggcatctatcgggaacatcactgaatgttccattataccagcaaatgcacccgctataagttgatggtacaatggcgcgtgggtggggagcgcctcataatcgggtagatccataggtattgctggaattggccttgttgaattattactcgacgagttttctaccataatatcttctttttttataacataaatatatttacagcaaaccttaagaggtgttaacgaatatgggaatcgtgattaattaagtgaagttacgatcccaagataaaataaggaagttgttgaaagaggaaagaatcgatgaagaaatgaacgacaaaattacttttgtcaattgtagggtacgaaacaccaagaaatgcaataagtgctatgtaaaggtgatccagtcttggttagcacacacgcccagtttctcgagagacataatgacagtaaacggtgagtataaaaaaaaagcaaaaaaaaaagaaaaaaggagcaatcgttcgttacaaacgatctagacttgatgaaaaaaaaccctaaaatgtctcagacctaaaacaaaaccctaagaagcacgtgatacaaacctgtcacgtgcaacattatggggtatgggtgtgtcacacatttgaaaaaaagtgggcggaacgtgtgtgggggggtgtcatgccatttccacatttggttgctctggagataagatccacgaatgaaggtgaggggcatgacttcagggatcaatttcccgcccgcaagttagtttttccggtgggagccgagcatcaagcatgaccacttcctggtgcagagagaaagtttcacacatataaaagaataaaccgaaagtaatgtagggagatgtttaatgtgatttttcacctttgttttaatgattacgcacaagtttaaatattacattcataagacagtaaataaacgtattaa

SEQ ID NO: 278 - DNA, 1000 bp, Saccharomyces cerevisiae
gtcttacttaagctggcagaaacctgtcacagcaccactgccggatatagaaggacaaactaacgagggtcagattggcctaatgaagtatttgggtttgaaaaattatcctttgacacaatattggtcaagaccatcattgctcttcacatcaaaaattcccactctaacgctgtactttctaggaagtacaaaggttgtggggaacattatattaaacggcattaaattatcgtcgtggagctcactcaagaagttatcagttccggttatagtggtaggttccttgttgggacttacgtatttaattcatgacctcccccgtgccttaccaatgaatctttccattaaatacaaaagaaagttgcaagaactggattacattcatcttaacgctcaaagaacctcaaatgaagtacgtgatgttttgcgtgtacctacacgtgaaattctaaggtcgtgtgaaataattatggataaaaaacaaatcactaagaaagaattggaaaacaaaaaagaaagtaacttgttgtcaatcaaattcttccaatctctatacgaaggaaccgtggctcaaaaattgatggtggaagaaataaatttagacatcgattagatattcttgtaaatatatgaggtcttttcaaatcaatatacataatgttacttattattttattccaagcaggtccattttttttttcactttgcacgaaattacataaacattaaaaggacccttgtgtatctgcttaatgatttgcaaaacctgcggaaacggaacgaaaaatgagcaatctcgttccggttccgagatccttttttttttttaaatcttgcgcatgtgcagattttaaaaggcgtcagatatcggatgtccctggaagtaatagctcctcgagtatttcctccgtttattattaatatgagcagttttttaagttctattattacattgatagtagttgcgtaaaaaacaaagctcataaaagtttccgat

SEQ ID NO: 279 - DNA, 1000 bp, Saccharomyces cerevisiae
attttgatgctgatgttgatgtatagtaaacatacatatatgcatatacgcacgtatatatatataagaatatgaaacccaaactgtggatattatttcgtttattatgatctctcgcatatcttgatacgaagtgcaagtcattataatatttagacttttcattacgttaatagagagtcactttaaccacgaggggaaaaaacacatacccctccccttcgaggtaatcttccggtgagatcttccctgtatgcagttcccgggcataggcgggtttaacatcttgctaaagaactatcgcactaaccctctggtacccaatgccgagattcggtaatgggggcacggcactacggaaaaaaaactacaattctaactctaccccgccccttacgaaaacgccctagctcaaccattccgaccgataaaaagttgccgcgatcccgtcgatcgcatttggttttgaggtaaaaaaagaaagcgacagggatcttctccacgatgctcgagatgccctggtcctcgctatggcattactctggcctcagcggtatttgcattcacaaccatcaccatcgggatggtaatacatggctcggcaatgagaagagttttggcacacatgggccactccttatgctttctttccgttgtctcgaagcgtgtggtgtttctattttcattctccttcttgggtgtatatataaaagaggttgtgttatataagacaacgctcattggcctgttcttgattttgattttttccgcttttgtgctgttggggctagaactataagtgtgtcgattgtttttatcttcattatttcttttgcatgtttagtatttagactaaatttatacgcagctactatcttttattatatattctggtaaaccaattaaagagagaaaaaggaaaaaaattttcacactaatattcttcatatagcatcataatattgacttattagagcaaataaaaaattaaccaataata

SEQ ID NO: 280 - DNA, 1000 bp, Saccharomyces cerevisiae
acacatacacttcactgcatttttaacgcgcgattttccaaattggtggtgaaacaccaaatatacctcgaccaattaatcttagccaaattagaagacaacacagatttggaggatatttcacacaattatcgttttttaaagccttacaaatttgcactcgaaaagattttgtctactaaaatactgcgaagcgactctttggatgatatcctgaaattaattaagatgtatgacaacaccgatcctgagcataatatttcaccaccaacccacagtggtatgttagaaattattagtaattgtttaaggaagatcgaaactaaatactggaaccatctattcactaatctaaagatgacaccaagagatttattagcactctgtatcgaagaaaatgaggctaaaatgcttggcgtacttctgttagtgtttttaaattacgatgagaaagatttgggagatgatctacattttaagaaatcagatttagggactgaggaaagcaaagctctaaatgataactctacaaaaaagtcagagaaatctgtcactaatttattgaaggatgaagaattaatgcttaaagtcttagagcttttggtgacaagtgctgcaaacgccacagacccaattaaagctaccgattcgtgggacatgtgtttccaattaatacgcttactcaaggaattagacagagaaaacaacacacaattggttcaaaaagcactcgagagattcaaataaatctatatgacaccatgtattctttaccatatagcttcataacattgaccaatcaattttcagaaatgcgtcgcgcgtagttttgcccgatatccccatcccttcaggatctttaaaaggtgatgaaagatgcaccagatagaaaagttgcattaaaatgattagcagagatatacaaatattttagtaagaatacataaagtatctttgctttcacaaataggaacaagcacataaatacagtataatagac

SEQ ID NO: 281 - DNA, 1000 bp, Saccharomyces cerevisiae
gctctaaaggtaatactgaaacgacaattgagacaactaccgaagtagagacggaaacagctaagcagtaggcttatcctatcctctatttccgccctgccccatcaaaaggaaggaaaaaatagtaaatacgggacttcctgtgtcgttttttcatttcctaggtttttttcaagtcttccctagtagtgtatgcacaaatatataaaattaaatacgtaaatacagcgtgctgcgtgctctactcaccaatatcttcaaaccaatcctgaggtctttcatcgataaattgtttcatgatctttttacacctctcatcgtcaacaacaacaacctcgtgacctctagtttgtaaatatttctcgcccttacttttgaaattaacgttctcaccgacaacacagcgtggaataccatacatgatgatggcacctgtacacatgtcgcatggagacagcgtcgtatacaaagtggtatctttgtacactttgccctctaatctcccacagttttccaaagtggagatctcaccatgtagtgtggcggatcccttttgaaatctcatgttgtgaccacgaccgagaacacttccgtctttgttattgataagacatccgccaataggaacaccaccctctttgtaacctaaggccgcctcctcataggcaatgtccatacccttctgatcccacttgcttgccattccccctgtcaccattagctatgaaatttttaactctttaagctggctctcatcaacataaaacaatggcttgtagatctcattgtcgaattgaaaatgaactttttaatttcgcaaaaaaaaaaagaaaagttcagggtctccgggtactaccgcccctgcaaggaatgaccggtgataatggaagagaagatattacagcgacagtataattaacaaacacgttgtgtctttaggctcgtaactaactgtacgtatatctacacaccataggtcactacttgcaatatatttgtt

SEQ ID NO: 282 - DNA, 1000 bp, Saccharomyces cerevisiae
gttgttacgagacaaattcataactagggacgaatcaacagcaacttacaagtactaagactggtgccatcttatatattacctaactactgagatagtttataatccgtaccagccctaactttttttccgacagcattttatttcctttcgtttttttcgacttcgtcgctttctcctccatataaaaaaacatcaagagataaaaactatctttcttgtccttgtccacgttcaatacaacagttacactgcaaacgacattagtgcaaatgcaaactgtagtcaatttgccgtatgcctgacatacaacaggtgttgtatgagtgtgacaaggacactttatatatctttttcaatctctctatccggccttcttggcaggatagcttttcgtttcaatttgttaatgatgataaccaaagatgcatagttcaactgattgaacatactatcgaaatgaagataaaaatttccatcgaaattagtctttcgctcctatctgaacattacaaaagaaacgaaaactgtattagtaatatgcttgtaattggagaagggccgaggggcgagaccattgtggagcgattttaaacctcttgcagcacgaatcgtaacggacccagcgcgtactttattctccctgtgcattcgtggaagttttgaaactcttaaaagtgggctcatctgtctggtattatctgtgcccctgttctacatgtactcgtgctttctttattgcttctttcggtaactcatcttgcacatgctattcttttcggagttaacgaagccaggaggaaccttaatggatttacctctagcgcgtcaaccctagaagagggactttttccacatgaatagtcaacttttaagattcgttagtagttgtatagggacatatatatgcacatatatataattatatacttatacacttgcttacaggggacatttttgaccctcaaaggaagtgaattacaggtattgaataacagaa

SEQ ID NO: 283 - DNA, 1000 bp, Saccharomyces cerevisiae
ttctcgagcattagatgattaaatcaaaatgacatagtatttcgcaacctttcagttgggctttgtttaagaagtggaatacttttgcttgagttgtttagttttattttatccactgttgtcttaacaaatattttcaagaccggtaagccgaagatgaaaaatcattattaactcattttttgaacaaaaatataaacaaaagaaaggcaacgcacaattttagagatacataaaacgcagtggatgttaaaaataacagcggtacagaaacgcctgtctcgctccaataataattatacaaatttgaaaccgaacgcaatgtgccaagaaatgtaaacacactatagaaaaaaatagaacggtgcacattgtgctagcatatctgcttggttctgaacaagaagcacctggccactttctcctagcccaattcttgccaagttttcaacctcaatcttttgtgtttgaacaagcatgtatgaggggtcaaaatttagtggaggccgcttacaatccttctatttcctctggacctcattagccgtctggccagacctaagcgtcataatctggagaatttcattgcatgcgagaatatgataagtaagaacttgtttatttatacaagttccacccactcatacacggctacaattatgacgtataataacgtttcgtctagcccaccttttttacttttgacgttttatttctttcgaggatttggccaagaatgccccgaacagcggaaaaaatggcgtcgcagtttcagatgtatagactcatcttgtagaaaaaagaatgcaagaatgaagtcttttcgtggtgttttgaaaacactataaacaaaccgtcaacaaacattttgtataaatatttagctatatattgaatatcttgaccagtaaagcaccttgagaaattgtaagcttgaagaacgtactttgatatccctccgtttcatcatcctatagctcgtcaacaaatcaaaaaaaat

SEQ ID NO: 284 - DNA, 1000 bp, Saccharomyces cerevisiae
gttgccaaagaaataccgaacctggagtttttaataccgccggaaatggcacataaaataaaatattaccatattgaatggacacacacatccaagatcgtcaaggacttatcccgattgacacgcattatacataccgctcattcgcaaggcaagaaaatactcgtacactgtcagtgtggagtatcaagatcggcgtcattgattgtggcgtatatcatgcgatattatggcttgagtttaaatgatgcatacaataagctgaaaggtgttgctaaggatataagtccaaacatgggtctcatcttccaacttatggaatggggaaccatgttgtccaagaactcaccgggcgaagaaggagagactgttcacatgcctgaggaagatgacatcggaaacaacgaagtttcctcgactacgaagtcctactcttctgcgtcctttagaagttttcccatggtaacgaatctatcatcgtcgccgaatgacagttctgtcaattcttcggaagtaacgccaagaactcctgctacgttgactggagcaaggaccgcactggccacagaacgcggggaagatgatgagcactgtaaaagtttgtctcaacccgcagattcactggaagcttctgtggacaacgaatcaatatctactgccccggaacagatgatgtttcttccttaagggacagcatctcccaaaagaatctttatgactatcagatctgcaggcagaccgcctccctacgcttctaaatagaatgtacttagcacttctgcctacatagtaattattcatcattgtaagtgtcacattgcaaaaatcgtccaatagacgttttcctcgtttgtgattggccctacgttttgcgccgatacaagcggcggcgaaaagttaaaaagaacaatcaattaaataagaaccatcagtcctcgtattttgtcttctgtttgcaagcaatgcaccaaacacaagatcaactaagaacgcatctaca

SEQ ID NO: 285 - DNA, 1000 bp, Saccharomyces cerevisiae
ctctttgtaaaaattcacttcgagaaaaggattatgaatatctaagaacctttatgatcgactcttggggcattgaaaaatgctttcaacttgaatcattggctgagttaggatttttcactagcaaaacgggaaaaactgatttgcatattacaacaagtaagtcaacaagattacagaaagaataccgttatatttcacaatggttcaatacagtacccatagaagacgagcatgctgccgataaaatcacaaatgagaacgatgacttctcggaagccacttttgcttacagtggtgtagtgcccttgacaatgagactggttcagatgttatatgataggtctatcttgttccataattattcctcgcagcagccttttatactgtcaagagaacctagagtttctcaaacggaggatttaattgaacagttatatggagactcacatgcgatcgaagagagtatatgggtcccgggaaccattacaaaaaagatcaatgcaagcatcaagagcaataatagacggtccatagacggatctaatgggacatttcatgctgcagaggatattgcactcgtagtattcctcggaggtgtaacaatgggtgaaatagctataatgaagcatttgcaaaaaatactaggtaaaaaaggtatcaataaaaggtttatcatcatcgccgatggcttgatcaatggcacaaggatcatgaactctatatcttaattattatatgatagatttgttaattttttgtatatgcaaatgtgctttttttcaccaaacggtttgcaccaatcatacgagagaagtgttcggtgtttacggaaaagctaggggactaagaaaaattgaaaataaaggctgacagcagtagaaaccattgtgctggcttagtgatttataagaatggttaattagttttgtatcctttaattttctagatagagccacagagcaaactaaacagaaaagttatccatttccattacgca

SEQ ID NO: 286 - DNA, 1000 bp, Saccharomyces cerevisiae
gaccacgaaaccacttaattgttgaataacggacatctaaagtcatatctatagtgcagcaagttcttcttcagctcaccccagtctcgctaaaggcatgcttactttgccgtaaagaagaaaggaacgttcaaaatgtgtttgatgcgtaactgtgatgattttctatcatttacttgcatgatatcggtgaaaattctagctagatttatcaatgcatagaagcagtaagtgatgccacagatatgagcttttctctgtggcgaggtctttgagaaattaagtggcttgtacagttttcacatgacgattggaaatgttgaaaaaagagcctaaaaataggccttatcgaacaacattaaactaataatcttctggatgcgatagtcttacttgataaaaatcattggcgatattgtgttacctggattatcaagctcgccactaaaggtgtctggatccttactcaatacaaagtccaaggaaaggtgtgccacaggaagaggtagcatccctttatttcttttcaaggaaagaagcattttcaatcacatatgtatacaatagtcttccgtgtggctgcaccgcaccaccttgcaggtcccgtgtatgtaggagtcgcatgcgaataaaaaattgagaaagatcatggggttttttgttcacgcgggccgcagttgtggctcctctgtcacttttttgccctctgctaagggcaaaaaagaaaaaaaaacgcaacgagaaaattaaaagtgtggcatttcgacatctatcgccattcgtgcggccatttctcgaaacaacgctaaacttttgtttcgactgtgaggccctagaacagttcgattctgatgtaggcaatggaagaaacaatcatatataactacagaacctaatgttacatgcttgcatctctcagctcccgcgaattttcaagtgagacttaatggtagccatctagtaactcataaatcaacgacattatatatcatcaactaca

SEQ ID NO: 287 - DNA, 1000 bp, Saccharomyces cerevisiae
caaatctgcctctttgttcaagcaaagaaagaacccaagaagaatcgcttggactgtcttattcagaaagcatcacaagaagggtatcaccgaagaagttgctaagaagagatctagaaaaaccgttaaggcccaaagaccaattaccggtgcttctttggacttgatcaaggaaagaagatctttgaagccagaagttagaaaggctaacagagaagaaaaattgaaggccaacaaagaaaagaagaaggctgaaaaggctgctagaaaggctgaaaaggctaagtctgctggtactcaaagttctaagttctccaagcaacaagctaagggtgctttccaaaaggttgctgctacttctcgttaagatttatgctcgaacttattatgtacaatgaatatttttcttttaaatcatttttaaatatttcaatttagtattattttctgtataattcattcgcgaggtataatctaccatccacttctctatcattatactcccatatttttttattcacaggctagacaatggtaatggtgctttagatgatttcagtggattacattcgcacaatagaataaatgactaattttcaagaatttgtttcaacctgccggcattcagttattataagttattgtttgatggtaaaacttcgccatcaccggttgctgcgtttattgcaaaattactgaaaccatgtaatttccgaatacggtaattacacgcagtttgaaatttgacatgcaagtttaacaaaaaaacttctgtccgcatctaaagcttaattaagggactgtttcataccttcagatccaatatactgaatatcaggcaattgatttcccttgtaaatatacaatataaatagttgtaagaagaggtgatatgttaagtttccattttgacgtattcctcattctagaatgattgtaagctctcaacagtcacttgtgtgccaaaatattatacctacttcatacattttcaattaag

SEQ ID NO: 288 - DNA, 1000 bp, Saccharomyces cerevisiae
agcctactgcattgtaatacctgaagagaacaaaccataacctggaggacaacagcccagtgtgcagggagatctgagaaagaaaggaaccacacgagagacccgagaggaaagaccaaatccctttcccaaactagttgtgtttttgtcaggttaatgcgtctgtgtatttctcagaacgcttacgttccaggtatttcgcacccattttgaattctccatatcgttttgcacggaaaacccatttatcatctattctgtatataaccacaataggcatctcatttcttgctttgaaatagtaggtacttttgtacgtaattcttctggtaaaaaaaaaagaaaaaaaaggaaggaatttgggtctcaattttcacccttttgtataacagtagcattcttgcatgtaatctccaatatttggcttgtgattgccatctctatacttcgtcagccattaccttttcccctccccttcccctcccctctcctattgccgcaccgccggctacaaacataactccaaccataatctcaccgcagctggcatatcctccggttttccctctccatcgcccattgtgtgccagacaaaagacgccgaaaaaaaccggaactgccgccgctggtcctgagaagagcaagaaccatacggaagagtctcagcaggcgctgctccaacttggcacacggcagaacctgcactacaatagcgttaggaagaagcatcatttttttctactgtttttttttttcttggggaaccgctcagggcctaatggaaacaccaatggatttgagaattttaacgctattcacgatgaccgtgactcagaaggaatatttaaataaaacaactttttagcaaattgaatactcatcgatgagcttcgcttgattgcctaatattcccccagttttataaacagttgggtcacatataactgaatacattcccagaaagatttagtaagaataaaaaataaaaatactggttaaa

SEQ ID NO: 289 - DNA, 1000 bp, Saccharomyces cerevisiae
tcaccaattccacaacatacacaacaggcatctccattactaatgagaaataattcaaacagtaacttgctatttgagaagaatttgatcaacaagtcatttgaagaactgagaagacaaccatcagttaacctttttagcaccttgatgaatggtaacatggaaaagaatggtttggcactaaacttcaagtccagaacgcctacagatgcgttgatggcgaatagcattaaaaatagtaacaattccagtcataggttactaaatctcgaggaagaagaccaaatcatgtctggatctctccccaaagaacgcgaggacgataacgattcgactaatagcacaatagtaccgaatcacccagacaatgataactataatgataatgataacgacaataatactggtataaattccaataatttcaatctaaatctctatgatgacaatgatagtgcaggctttacagatgtaacaactgaaggagtgaaatactcaaactcgaattctacagtcaccaaacccgtttataaaaaagccgtcaccctggatttatacggcgaagatgatatggataacatgggaggatgggtattaggaggtaatgcccggtaaaataatcacctgaaaaaaactaggttaagcacaaggcaagggaaaaagccaaattacacatatacttgattataaatagattagtaaaacatatattctaaattaaaacagcactttaaccgatattgtatttttttttttgggtttacgtgatactgcgtaaatcttcaattttcagggctttgtccgcaaggggcccgtttatttatcaaaaaaagtaatgagattttcgaagaaagttcataaacctatagatcttgttacatttggcaagaaaacaataagtgggatctgcggtccaagcaacgcattttcttttctctaatcgacaagttcaagtaaatatttctattagtcatatatctctcgagcttatatattaata

SEQ ID NO: 290 - DNA, 1000 bp, Saccharomyces cerevisiae
acaacttactctgtagtactctttccaagggagcgggaacggtattcgtgctggcattgttgttttcaggacagagtgccggtatcgtgtgtacgttgagtggacaaatggttagtgaagggttcttaaattggactgtttctccggcattgagaagatccgccacaagagcggtagccatcacgccttgtttgattttagtgcttgtagctggacgtagcggcctctctggtgcactaaatgcttcccaagtggtactttctctcttgctgccttttgtttctgcacctttactttacttcacttcaagcaagaagattatgcgtgtacagcttaaccgtaccaaagaactttcaagaactacagacaaaaaacccgtggccgaccgaaccgaagatgatgagaccattgagctcgaagaaatgggcataggcagcagctcacaggagcgcagcttagtttctcctgctccagaatacaaagacatgagcaatggaatgatcgtcaccgtgctcgcaatcatagtatggttgattatctccggactgaacttttatatgttactgggctttactacgggcaaagaagtacacctctaatataacaattctttagactagtataagtatacattttatccaagaataataacagaaaattccaatcaaaaagttggtgttaggctatactgatggccgtatcgctccatacgagccaatcagggccccgcgcgttatttccgccgcttacagctttctttgaatctccctatgaaaagggacctaattggtccggtcaaagcattaataaagatcaacaattgctcttgcttatcaaggtgccagatctcaaggttacctcatttctttacatttcatccacattttagcacacttatttattattacaatttgaaaaattgtatcacttctgagacttagtagcggagataaacagccgaacaattgtatttgacacataaactaataaatatacaaca

SEQ ID NO: 291 - DNA, 1000 bp, Saccharomyces cerevisiae
ttccgaccgagtcaaaactagcatcaacgcccttaccattagtgaattttaaaacttgtcttaaaatatcctctttcgaagcgttgatcaagtattcggcgccgtattccttcgctattttaagcttttcatcagttgaggcaactgcaatcgtatgtgcacctttcatcttgagtagctgatttaaaatcaatcccacaccacccgctgcggcaaaaagtaatacatagtcgccctttttgacgtgatacgcttcgtttgtaaatgataaagcagtgagaacttgtaataaaccagccgcataaagtttcaactcttcgtcactcgttccctttggcagcttcatgactgggccttgggacgaaatttttgaatactgtgcaaaagttgagttagatatataagcaacttggtctccaacttcaaaattagttacccctttaccttttgctacaacggtccccgacgcttccctgcccaatacgtatggtttttcacagggataaatacccttccgaaagtaactttcgatgtaattaacacccgtgtacttatttttgattagtaactcttcctccgaaatcgatggtacaggataatcctcatacttgattacatcgtatccaccaatttcatcaatcaaaatgactttttgctgttctggtatagtacatttcatttttgtcttgttgttagcgatctcgtctcttaatgcttactagtagcttcaaaatatctactttgcaaaccgcaaggagatctcactttcaagatatagtatttgtaagaggggaagttaacgctcggctaaatcgttcggatcgacaccgagcggcacgtactatattatccgaactgattactcatctagaaatgaagggtgcaacttctaatgtcacgcaagaagtgaaagtattattcatgttatacctgaataataatcatatgtaggagtaaatctttgttctgtgaacataactgaaaaaaaatcagttcatca

SEQ ID NO: 292 - DNA, 1000 bp, Saccharomyces cerevisiae
tttcatataaaaattgccagagatcttcgattggggtataatgcaattttgatatttgaataagatatcccatttcacacagttgcacgaatagtgatgaaatggtgtacttcatggaatctgacgtgacactacttagataatcttccactgttaaggaccctaatgatataacgttttgtacaatttcagccaccagctgtttatgctcctcttcgtcgtttacacgcatttgcgtaataatttcgtcaataatcaaccctgagtagagtaaaatgtgtatcccttcctcgttatagtaataataagtcgtttttttcccggatattgctgtttcttgcaggtacttaacacaccttaattgagttaatgagactagtgtcgtcttgacgctgtctacatccataccatctattttctccactaactcgcgcacactcaatctgcccagcgcaaccaacatcccaattacagaagctgctctttcacccagatgtgccttcaccaactctttgtaaagaaacaaatcgggattcaaggttctctgttccaaggatgatatggtcataacatcttcgggggtgaccaacttctcagattcgacagtgctctcacctgtttggttctctgcactaagcgcttctcccagtaactcgtccatttggatcttgctcaacaaaaatttttccctattcctgtgtcagcaattctctattgttctcaatatttcttccactattattattttgatccaaaattatttttttccttcaatgcgatgagcttttgaaaaatttctgatcattcccaacgaaccaatagaaggcccgccccgtcttatatccgttagcctaccaaatatatatataaagaacaagggcctttcctcagagcgtttgctgacgaagttttagaagttaataaggtttttaacagcagtgtgctcgaacgattaggacgggagagttaaaattattaaaaggaaaaaagaagaacgttg

SEQ ID NO: 293 - DNA, 1000 bp, Saccharomyces cerevisiae
gagaaaggaagcagccaggaggaatacgcggctttctcgcggagcccgattgccgatacaaaggaactgttgcctcctcccggctatttccataggccttcattcagcatactgttgtgtagttgcatcacatccttgttgaatgaattccaactatttcgataaaccatcccatgaaggagaatgcaatgcggcttttgtttgtaaacgggcttgagaggttctatgcggttaattctgtcactaggggtccgaatctcggattaagtataaaatatgtattaccctgatgattgaccggatgatgtaaggatgcatgtccctactgttttggtatttccacatacggacggggccccgaaacaccacccccattttaacggccgcatctgagcatcggcccatttggcacacgcccgttagtgacgttggtaggggcatttccctgaggtaggcccaaggttgctttaaaaggtccatcgcaaaccccttgtccgcggacctctgcgtcataattaaaatgcccaaaacataaaagtgatcgccccctcacagaaacttatgggcagcttgctgccttaacggaattgactagaattggtttgatttttttttcttcctacttcttcttccatttccctcccctcttcctcatatatgtatacagaaaaatcatacccctataaattccttggccccaatcttctgtcagattttcctttataaaagagtctttgttttgtaattaaaagatacttttttctttcttcttctacgtctccttttttttttttaagaaaatttaacttataccactattttgttcgcaattgatcaagaaaaaatacaattgaaaaggttttacatttttaatttttctgctcatcgcgcttttttaaaaggataaataaacatttctttaaaaaacatcttcaataagaaaaatcggttaaaaaaacttttcttctcaaagcatacctaataacaatataatcccata

SEQ ID NO: 294 - DNA, 1000 bp, Saccharomyces cerevisiae
aaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatagaactaacgctaatcgataaaacattagatttcaaactagataaggaccatgtataagaactatatacttccaatataatatagtataagctttaagatagtatctctcgatctaccgttccacgtgactagtccaaggattttttttaagccaatgaaaatgaagaaatgcgtgatcggaaattacgggtagtacgagaaggaaacttgagccaccccccaaattttattcatataataataggaaaagcaacgacctcatctctcgaacattgtttacttgagcaagtccgattaagagtaagttgtcgtacgttaaatacaaataatcaacaaaacactacacaaaaacttctacgata

SEQ ID NO: 295 - DNA, 1000 bp, Saccharomyces cerevisiae
tttctttttttccatgaaatattcacattgcaacctttctgagggtttcgccctcttaacagcgggcccattattatcttgtaacatccttcgctaaataataaacctgaactgtacttagcgaagccttcatagcacctacgtacacgtatatatagacattttacgtaatggagaaactgaggtttttgttttcactttttttctttctttttcactattgctcgaaccgcctgcgatgagctaagaaaaaaaagtgaaagaaatcatagaaagcaaaaatgagattatatagcccagagccctcttctggcgcctgtcccaaggcggaccaacaacaacacttgcccaaacctaagaaaatcccctcatacttttccgtttgtatctcctactttcttacttcctttttttcttctttatttgcttggtttaccattgaagtccatttttactacagacaatagctagtcattcgctatcttccgtttgtcactttttttcaaatttctcatctatatagcgaagtacggaaaagatgtcacttgccggcatctcggccttccccggccaaatggactcatcatctacgatacggcccctttaatccgcaattactttgcccattcggccgtagccgttctaaagccgccgtgccttgcccccaatactcccctaatgatccgggaagttccggtttttttcctttgtttagtggcattttgtgttgcccaaggttgggaaggtccgatttgactttaaggaactacggaaggtatctaaggtttctaaaaacaatatacacgcgcgtgcgtagatatataaagataaagatttatcgatatgagataaagattgctgcatgattctccttctgattctttttccctgtatatattttctccccttctgtataaatcgtacagtcagaagtagtccagaatatagtgctgcagactattacaaaagttcaatacaatatcataaaagttatagtaac

SEQ ID NO: 296 - DNA, 1000 bp, Saccharomyces cerevisiae
atgggaatagtgccttagcgtgacatctttttcgccttgttgtatcatcagatgcaacacaatcaatgccttataaacaatggtccaggctgtatcagacaaccttatatccaatgcgtgggtaatctcttgcaatcctcttgcgctcgaagtgcccgagagaatagggtccacatatttttgctttggaggggccatctttattttggtcgcccctttaaccaacttagtatataatgaagacattgtttcacaaacacgcctctatatctattataggggtagccgagacagtcgcgcttgtatgcttgatattgttactctcgtagatgttagcaagcgtagcaaattggtactcctgctacagatttattttttctccttctaaaattataactcaagcaagaagccctaataacaagttaaccagactaataagtcgactttttcctcgaatgtagaaaagaaacttttctacgcagctgcaaacttaatctatccctccaccaaagcaaaatgaaaacaaagccatactgggaaaaatctgaaaaaaaaaatggtaggagtaaaagaaaagaaaaaataaaggttaccctgcagtttggatagtcgggtaacatttggcccttttcctccttgattggatattattaccccgattacccctcatcttgggagtgccccgcttttatttctcccgccaatcggctattaacggctttacgtcattccgtgggcgggtcaagcgagccgctccctggtttggtcacgcaaaaccgaaaggctcaaacaaaactaaggccatcatatatatatatgcggctgcgtgcgtgtattctcccggataatatggtgcgttgcaattggagtattggagaaaattttcttttccctttcattacggcggaaatacttcatataaaaaaaaagaatacaatcagtctttaagactatacgcataagcattcaagacacatagaaacacaaacctatattttta

SEQ ID NO: 297 - DNA, 1000 bp, Saccharomyces cerevisiae
ctaaattcgcatggtgaagttggtagaaatgccatgagaagaggtgatttaaccaccttgaatttgaaaagatatgagcacttaaacagattatggattaacaatgaaattccaggttatattagtagagtaatgggtgacgaatttcgagtgactatactttccaatggtttcttgtttgcatttaatagagaaccaaggccaagaagaatacctccaacagatgaagatgatgaagatatggaagagggagaagacgggttttttacggagggaaatgacgaaatggatgttgatgatgaaactggacaggccgccaacttatttggggttggcgcagaaggtattgctggtggcggagtacgtgattttttccaattcttcgaaaactttaggaacactctacaaccgcagggaaatggcgatgatgatgcacctcagaatcccccaccaatattgcagttcttaggacctcaatttgatggagctactatcataagaaatacaaatccaagaaacctcgatgaggatgactctgatgataatgatgactctgatgagcgagagatttggtagattcaagccctctactatgttttatagttgacatatttgtatataaaaacttatacattattaaacatttgcgcgtcgattgacttttatttattattaacaaagaagtaataccaacctaattacaaatacttcgaagtgactatcataagtttccttatctagcgaaggcaacttttgaactccccagttgttaatatgtatcattatacacgacccaatcaaacgcggggaagtcaatgccgaaagaattctaggacctaaaagctgctcaatccttgggcctttccctaatgacatcccctctcaaactttagcttagcagttgtatttaatgtcctgtcacggatagtcaataatcgttgaaggttgattttcatatccttcgcaatttcgtaaagcaacaatagcaatacggactaaa

SEQ ID NO: 298 - DNA, 1000 bp, Saccharomyces cerevisiae
cgagcaaaattcgctctttatctttcgaaggcatgaccacaatagcgcaagtagatatgtaaataaatcttcctaaaccggtctcggaatgcaaagagcttcgtatttcaaaattacccgaatcctatacatgtcaggaatcaggttatactccctagctcttttcctgtttgtccatctttttcctatcatagatggttatggaggcggctgtttctgtaagaactacggagtcgcggcccggaatgggagaaatgcgaagaagcaggccgcaagtggaagaaattattggggtaaaagatcaactaatgaactctggatataaaaagtacagttagcgtttcttcccaactttcttatgctgctatcagcaaatgcatttgcataggctacaagccacaagccacaagccaataaggcatatgaataataagagaaaaagtgcctaattgctgtttatatcaaccgtatggcgtgctttagctgcaataaacttgttttcgccgattaccactaatggccgacttccacggatcccaaaaatagtgccacgtcggtacggtcgggcatagtggttattatttccgggttgtgacccgcttcggataattgatctatccccgaggtaataggcccgtgcggttccgtcttcatgaagctgcaggggctccgcttaaaagcccctgacggctcaccttaaatccgtgttacgacactatgccaaatgaaggaaacactgaaatgattgcatacccgcactcgtgcttacatgctaattgtccttgtcagagcaaacggtaccggaggcttgaatgtgtttatgtgtatatatatattcgcctgtatggaaagttataggttgtcaatttgttgtacctgacacatcgattttctagtcatcactttcctgaaaattacagaataaagataccatcttatacacacacatacacacacaaagaagcatagacatcgtatacatatattttaagttttacta

SEQ ID NO: 299 - DNA, 1000 bp, Saccharomyces cerevisiae
ggtaaaactgtgacaccctcctcagagagagaagaatctctcggtttggattggttgcattttcaaggtggatggggtgatcaacaactaccagctagagatccaagacagaaatggtgcgtagctcaatggaagtatatcggaggtcctcgtggccccctgtttaagaaattggatagattgaatctatgcggcggtgtgaaaaagtggaatttctggaatggtggctgccccgcaagaagattgataaaaaaagcagaaggcttggactctgagagcactgatcttatgggtgataattgtggtgtcctactctatagaatcagaccaaaatggctgagaggaattctaagatttctaatgtggagaggtatactctgttctcttatggaatttttcaccaattgaagaactttatgacaacagaatgttctgattgtaatataatgacaaattttaatctttagtaatatctaatataatagttaatgataaatagttaattctaatgtttaatgatctgcaaatactttttatgtttttcaacatagtttttaatgtgtttctacacttgatcgcaactaaatctaaataaacacacaagcacaaaatatgataaaaaagcaatttggctagaagcacaggaaccaaatatgacgttcaattcaaatagacccttatttctggtcttgttcatcagtccctgatgtcttgctctttccttctgcaattgatagcgccacacttctcaaaagcagtggaaaaaaaaatcatttcccagaagaacgcgagagaactccatagaaaaaagggaactttcctactcaaaagagaaagggaaaaataattgcgatatatcttatagcctttttttttttccaactttctatttttgtaaaaatgaaaatttccttcataagctacaataagactactccatcccttgtttcctcaacgcaccgaactcgataggactggtcgtaaaacagaaaactgacta

SEQ ID NO: 300 - DNA, 1000 bp, Saccharomyces cerevisiae
gcgaactgacataaccagtagaaaaaaagatggaatcagctctgtagtgctggtttcaatcctgtttgttggtgaaaaaatagcaccagaagggcaattgtacgtttccgtaatgtcgcacaacgcaatggaacattggaagagcaagctgagcaaaacaagtacctcgacgtacgtcctcttggccgtgattgctgttgtatttttggttacaatcagaagacccaatggcagcaagggaaaaagcagtaaaaagagggcttctaaaaagaacaagaaaggtaagaatcagtttgaaaaagcgccggttcctctgactctagaagaacaaattgacaatgtgtcgttgagatacggcaacgagttggaaggtcgtagcaaggatctaataaacagatttgatgtggaagatgaaaaggacatctacgagcgtaactattgcaacgaaatgcttttgaagttgctgattgagttagacagtatcgatttgattaacgtggatgagtccttaagaaggccgttgaaggaaaaaaggaaaggcgtcataaaggaaattcaggctatgttaaaaagtttggactctcttaaataagtttgtatttttagtttatagataacggctcttgccgaattcataggctgcactcattccggtacggtacacatttgttgcatttattatattagagatgcgttgtccctgtttttctacctccgacatcatgctgaaacatggcatgtaattaccgtaaaaggaaattacatggcgagtgtcacataatagcgacaataacatgtatacacagccagctattctgaaacacaccacattatagttattgaatgtgtgtgttttttgataacagtataaaagtgaagagaaagcacgtcgagccttgtcatgatgaattctttaatgatcttcgcgtgatttaattctagtggttcgtatcgcctaaaatcataccaaaataaaaagagtgtctagaagggtcatata

SEQ ID NO: 301 - DNA, 1000 bp, Saccharomyces cerevisiae
acgacgaagatgacgacgacggcgacggcgacgatatggacgaggaagagtccgatgaagagcaagtgagcgatatagagaacgatttagagattgacgaggagttccactacgatctgggcatgaaagtgttacccaacttttgtaccagcataaacgaagtgctagactccagcaagccctggatagccaagtacgagatcagcatccgtggccacgaaaacgaagacgtgtctctggagcaactcgacggaggctacgtcagagccatgcaactactcaccaagggtgccggcgcagaggccgggaaccaaaggtccttcatcctctacacggacctgagcagcgagtccacctacgccctgacctatctcatgggcgcagctgtcaaccagggagacaccgtctacattgtccactgggagccctcgaagcccacggacgactcccagatgttcgccaacgttgccagaatcagaaagcacgtcatgcacctgtttgactgcgtcgcgggcgtgctcgacgacctcgacgtcgtcgtcctctccttgacccatccgtacccaaaacacctcctcaacgagatgatccacggcctcaagccagtcgccctgtgctgctccctctcggtcatcctgtccactctgcagaacttcgtctgctctgtgcccatcctcgcggttagaaagaagctgaaacgtgccaagcgcaagggcatcagcgagtgaccaataatcactgcactaattcctttttagcaacacatacttatatacagcaacagaccttatgtcttttctctgctccgatacgttatccacccaactttatttcagttttggcaggggaaatttcacaaccccgcacgctaaaaatcgtatttaaacttaaaagagaacagccacaaatagggaactttggtctaaagcaaggactctccctcccttatcttgaccgtgctattgccatcactgctacaagactaaatacgtactaatat

SEQ ID NO: 302 - DNA, 1000 bp, Saccharomyces cerevisiae
ttttttacccaaattcgacagtactttctcagaaaacttcaaggctaagactaatcccacgttgtttgtcgttgttctagtggaaatgctttctgaactttctttatcatagtcgattagcattttgtcaacctggtgaaataattctctcctccacattatcgcgacaccatggttttttgtagcatttctataatattgtccatcgtatcccaatttactgaattcatctttccaaaagctttgaaactgaatatgatcaatctcttgcaaacaaatgacatcggaattataatatttaaactcgtttaagagaactttagaacgcctgtaccattttaaagcgtcaccactatccgggaacagctttctgcggattagagcttgcgccaagcaattataagtcattagcttgaatctaaatccagttactggctctgcctcatgtagagataggaaaggtcttctgataaaatgcagctctggcgggcagtccggatcaacaccttgagccaacattgcatctcttttagcctttctcataacttccctttcggcacgaaccttagcgatatgttctggggtcactatgggcttcgattttttacctttcttgcccttctttttatgttgaagtaacgaatcatcattggtttgatgttttgcatcttttacagatttattaatttctacttcttggtcgggcgcaacatctggggcaaccactttgacttctttgtcttgtgtcatatttacttaatactcttaactacaattaagaagctataaggagactacaatctcatcttcttgcaacactacttttcctttcctcttgctttagtgcaaccattttttgaaaaatgaatggtctttctgcacgaaatatctctcgaagagcttttctagatattaaggataaagtatatcatcccaaaagttaggtgatggaatcaatattgatggaccagctaaaacacgttgaaagcagatatcagga

SEQ ID NO: 303 - DNA, 1000 bp, Saccharomyces cerevisiae
aactagtggtgactgaagatctaaatggtgacggagaatataagctgctactcaacaaatttcctgtggtccctgaacatagtctcctagtgacaagcgagtttaaagaccagagatctgctttgacgccaagtgacttgatgactgcttataatgtgctctgttctctccaaggagacaaggacgatgatgtcacttgtgaaaggtatctggtcttttataattgtggacctcatagcggttcctcacaagatcacaaacacttgcagatcatgcaaatgcctgaaaaatttataccttttcaggacgtattgtgcaacggaaaggatcatttcttgcccaccttcaacgcagagccattacaagatgataaggtttcctttgctcatttcgtcttgccgctgccggaatcgtctgatcaagtggacgaagatcttcttgctatgtgttacgtatctttgatgcagagagcacttacatttttccaagattggaccaatgagtctccggagttgaccaagtcatacaatgtgctactgaccaagaaatggatctgtgtagttccaagatcgcatgccaagagtggaccgccattgatgttaaacattaactccacggggtactgtggtatgatcctcgttaaagacagagaaaaactagagaacctcactgaagatcctcatcttgtggacaagtcgttactgcaatgcggtttccccaacacagcaggccaaaaaccaacagagtatcactattaaggtctattagccatatgtacattgtctatagatgtgtaactgcgctgtgatcttgttttgaccaatcaggagcgacgcgctttttatcgggtcaccccggcggggggcctgacaatttactttcatagagcagtaataaaagggaagagatgtaaaagcttggaaaaatagcagtaaaggttgttgttggacaatttatcagaatattagtaactgtaattaaacgttccagaaagaacaaa

SEQ ID NO: 304 - DNA, 1000 bp, Saccharomyces cerevisiae
ctccacaaatgcccccacaaacaataaagaaacttctccagaggagaagaaaataagatctttactaaagaaattaagggctattgaaaccttgaaggaaagacaggccgtcggtgacaaactagaagatacgcaagttctaaaaattcaaactgaagaaaaagtgttgaaagatttggaaaagttgggttggaaggatgaataaactagaagaaactgatgtatccatacaactgtgtaaatattaacaacgtcaaataatactactttgaattgttttttactgtttcccaggagaattacgccaacctcccccctttctttttttcccttgttttattgtacttttccacatatttttttaacatcaaatagtaattgatacatacataattagtgagcattttccttatttttacgtctcttcttggcggattgccaccagccgcatcttacaatgtatgccacgataccgccaggcaataaatgaatatggagtgtcacttcggctccgtaagccggcgctgcatccgccaccacagttttttttagcgtcgctgtcgccgctttgccacagaaaaagaaaaaaaaaaaagaaacggcgccgtgtagggttttgtataacagatcggcctagcagccaggagatggcacggcgccaactgaaaagttagactgtggaattgccgttcaccacactcgagtggcatctaataaactgccacagttgactcaagcggtgctaccttcgcagttattgcacaccatggtaacacataacacagtcttgcattacaaatgtggttcctcctacttggcggtgaatttcttgagtcagcccgttattttcatatggtgatgtaagattacatacagtatatatatataaggatgattctcacacaaacttttccgctgttcatcatattttgtttttggattagtttcacattctgtagaaatctttaaagacaagagaagagaaaacaaaggcggagca

SEQ ID NO: 305 - DNA, 1000 bp, Saccharomyces cerevisiae
ttaccatccctttcaagttttgcaatacacttcatgagcaaaacagtatatggaataccagaaaacgtggctgtatccattttacttaggtcaaatgtatctacgtaatttattagttcaggccaagggttctgtaaccgtaaatcatacttcttactatctgggtgtgcttgcaaaacaaaatgtgtttctgagagtaccagatatatatatccataaaatccagagacgaaagtgtttagaacaggcggaaactttgttcctctctgccgcctaatctcatttaaatcgagcatcgcagtttgctcaccaatacaagtcaagatcaccaccgagaagcgggtccaatcatactgaggttgctgtaacgtctttctaaggtcattttcctcatattctagctgtttagaagccaatggctcaagatcttttttaagctctgctaaaaacagagaacccgattgaactgcacactctactttgagccaagtaagagatgatattccggcaagcaccagattcttaaaaacttcctgcagcaaaggtgtagcaggtcctaccacgcacacacgggaccggttcaaactatcttggcccaatgctccccatagtctcagctgtctatcatatctttccatattttcatctacggctgtctagttggcctaagaaagaaagagaggcgactcatttttttgacgtcaatcgtctgacttgtccttctatttcattgctaggctagaaagcttagctcttacaaccccgctcgttgcagccgagtgaaaaggggattgcgaaaggcgttagaggggataaaaaggggccctttaaaaaaaagacggaaaaaccgggaagatgcaacggctaaatcgcaatatataaacaggtgagatagaaaagaaaaaaatcagttaacctctttcctcaattccaatgcttgaccgtaaattctctttatttggtatacgaaagattaaactttcaaagctccaacacaaga

SEQ ID NO: 306 - DNA, 1000 bp, Saccharomyces cerevisiae
atatttttaaaagtaaagacgtcaccatactttttcaccataagaacaattactggtccagattaagaacggttggagtaagagccaattatcattcattgactggtatttccttttgaactatattatcatataataggtaagaagatggcaaaaaggaaggagaaacagtggtctgatgtgatagggaagtaaatgtcaacaaatacctaacagtactatctgatcgaacaaagaaattccaccaaactgtcagtaaatttatttaatgagcagcaaggacatagtgcacaactagcactctacttcgattgggttattgaggaagaggatagtatgcccggaattttcaagcatttacatgattatggtttcattggggtgcaagaagacccagcatgattagattgctatgtactcattatataatatatctccgatgaatatatttccgaaagtttactgaaggcgaccttggataaaccatagttttacggcaaatacaccatatcactattttctttctatatagctttgctaaggctttttttagtgaccgagacaaagaagaaaattttccataaatgaaagaccattgtttattccgaatcaagttttccgaagaattgttgtattacacagtccagagacagcagaatctttcagaaattttaatactgttgtgacagcatcttgtctattatttattggatacgcaaaactcatttttttaaaattttttttataatttcctttaaataaaaaggttaaagctgggaaaaatgcatctaaataataaactaatgatttagtttccctcatttaaaatatctaagaaggacagaactttgtttggggtacttacccttgagtatttttagcgattattcttggagttctcagccagaagattaaaagaatatatgttactgaatgcagtgtgatactcaagactaagtagtcttaacaacaagttaacaagggcgtgtggtctagtggt

SEQ ID NO: 307 - DNA, 1000 bp, Saccharomyces cerevisiae
gacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcacttctccgatagacttgtaatttatcttatttcatttcctaacactttgatcgaagaagagggataacaacagacgaaaacacatttaagggctatacaaag

SEQ ID NO: 308 - DNA, 1000 bp, Saccharomyces cerevisiae
ttatactctcttatagttgatttatttccctgcatgtcgttctaaaaagggaaaattttgtttacctgttcaatcgtgaaatagccaaaccgaagtcaattgtggcagcagttaattaagcattgcaagaaagaacaagacagatgataatagagacaccgtacaagaaagaatccaaattaagagaaccatacaaagacataaaatataaacctttcaatgtaaaacaaaaggaggaaaaaacctgaaaagccgtgaaaaattcataatcttgcgatgagttgaaaaagtttgttgtcaaatgtccatagacttacatgtagtaaatatttttggtttctttttttttcttcgtgctttttttttttcctacgggtttacattgtgccaatgtgaatttccccgccactccctaccgaacgggtagcagcgtagaacatagcgatcaagggtgtgctaagtgaagaagcaattcagtgcgggtaatacatattcctagcctcgtttgccgttacattgcattgatggtacaataaagggcatgctttatatcgagatgtttcagtgtatatgaggggaaacagaaaagagtcattcctgccattttttggtcactgctttttctgctatgagtaatggtgaagttccttgtggctacacgcttaatgtcatcgggttactgctcctaatatccgcatataagctttatgcagggatcagttgggcggctatttatctacacccagtcatccggcgtgactggatctccacttgccgcaataagtcggtggacaaatggagatttaagagtaaagatgcatgatggtataattcctttagtcgaaatagatatatttcaagcgcatatataggcagacgcttgtactgtagaaatagccgatattcaattgcgctctatgtgtgtttttattccaggttttccttggattctacgtattgtacgactttcttatcctccacaaacgtcatcgtgtcagta

SEQ ID NO: 309 - DNA, 1000 bp, Saccharomyces cerevisiae
atagaagtgtactcccaatagagacaaagccaagatacttttgtaaaagaacgaaaaaatggctagagcaagaaagggtgcactggttcaatgtgatccatccatcaaggcgctcatattacaaattgacgccaagatgagtgatatagtactagaggagttggatgacacccatcttttagtaaatccctcgaaagtcgaatttgttaagcatgagctaaataggctattatctaagaatatatataatcctatggatgaagaagaaaatcagtaattattgctcattcagctttttcaatactatttgaatagagcatgacctgcataaccaggtcagacatgaatatagaggggaagtgatgatctagtggaaatacgactatacaggtatgtacatgttagaataataaatataaggaagaaaaagtggtcaggtgcaagtatacatctttaaccgttttcttttctcatccttttttgagagccaaatcccgtttaattttttctttttcctcctcaaggtctaaaccaaactcctcttgtatctttttctccaacctaagccttttctctaaacgttcttttttcatccttgccagttcagctttaatctcataaggctcttttggtatttggttcaacgttgcaggatctggccaaaaccctggaacatttaattttttatcagtatctgtaccaatatagtacattacagcaacaggtgctagcaaacaaaatgaaaatctaaagatctccagttgcgcccttgtatatttaaacttgaagttattaaatagacccattttgtacttgtcgaagtgattacttttgtttgtcagcccttattaaattgttatagaacagaaaatatcagcaagatgcgctgatatattggaattatacgggaaaaaataaccatttaaggtcaagccggtaaagcaaaagtgttggtgatgaagaagaaatagggagaaaagaacaagtcacaagggtgagt

SEQ ID NO: 310 - DNA, 1000 bp, Saccharomyces cerevisiae
ataaagccaaaaatctgccacatggcgataaaaccgaggaaatgacagggaaatccttggagtttgtgttggattgctcaaaagttgggtagctttggaagagctctatatcctgagaggttttcaggaaaaactgagatgacataatgtttaggtgttattgaacctgactgtttgttgtagtactatgtttttttatcgagatgcaatggatagtttaaacacaacacgtctcaatcaacactaaagaaagttatgattcggtaatctataggttgcttctaccgtaaagaattctcgctatgtctagtcgtctggatagatcgaggaaaaggaatcttcattgaataacgtacactgaaaataaatcgctatgaagctgaaatttcattgatggacatgaagaaagcgaagtgaaaaaaaggaagaaaaagaaagtattgaggaacattctgcggtcgggtaataatatcgtacagtatgacagcggcaatttttaataatatttctgctcactaataaagtaaagaatataaagaaaggaccttaatctaagatagatgttactttttcatcttgcagttttaacacatagaaccgagtctaaacatattgaaatatttcgatttcttttgtacgagtgctataaaaatgggaaagaactaaaaaaaataggacacaacattaactgcctgagtttcttgaggaaaatattaaaagaaatattagttaaataaatagatttggtgagatgtatttctatacactgaaagacattcatacgcatctcatgatgagtcgagcgccttgcgttaagaaggcgcgtagttacggttacgaaaaaaatgaatagaatacaatgtagagagcgcccttaaaaggcccataaagagggatgacaggtatgagccataaagctgcaagcctctacggaaaacgatacatcacaaccaaggaaagatagacagtttatattcatagataatagggggaaagactt

SEQ ID NO: 311 - DNA, 1061 bp, Saccharomyces cerevisiae
acaggctattcaaatgtgccagcaaggactgcggtacacctcaacggcagagcatgtagctatcagatccaaattgcaatatcgtctagagctggcacagggagcggtaggttcagtacagatccctgttgtagaggttgatgaactaccggagggatacgaccggtcctgagaaaagagaaagggaacacttctaatttatctttaaaattatatatatatatatatatatatgtgtgtttgtatactctgtgggtatttccgtgtatatggttaataatagtagtatcttgtcagttttttttatgtttttcttcgcgcgtcaactttctaccaagagaaaaacaatataaggtctccttactctataggagaataaaacaaacaaaaataaaaagcacatcgtagcgccaagaaaatactgcaaataccaaataccacaataatactacaattatctatacacaagtgttttgccgcttaaaacttcgattttcatagtacgaaactatacacccttggtttttctcttttctaaatacatatctaccttgtaaagaatttcccgcacatctttgcgggcatacagttcatgtattggcaactaacggaactaaggcaacatatcttgcatattgcaatgttcactatatagatgaaaacttatatctaggtttcacgacacgagaataactaagaagcacgatccatgatatagaaaaatcagttacgacgaagcacggcaaattagccgccgaagaccgatatttttgccaccggtcacagttttcttttccacggagctcttcgcggtttttttgttccggattttttttaccggctcttagcggaccgttttggttataaggggagtggcagcggcggtagacactgcgctctataagaatacttgcaagggtcttgtctattgtataattcgctagtatttgttttgcattgtactcttaataccccaaccaaaaacaaaatagtgagagtaatggtgcgttttgtttcaattttaagtttattcggctgcgcggcgacgcttgtcacggccc

SEQ ID NO: 312 - DNA, 1000 bp, Saccharomyces cerevisiae
caagaacaagagcaggtacagaacccagatacacatgtaaacaacgagcatcagcagcgacctgggccaaccactctattgagcacgccagtacgtctcaaaaatggctttggaacaccatcgccgccgtcaccaccaggcataacgaaaagcatcactaaatcgagaagaaggccgtcgacaacgagtcttcagggtatattcatgtcgcccgtcaataagcgtcgtgtcggcataaccgcacatggacgtgtatatgaccataacgacgacggacacgaaagtgagagtgaggacgacgaaaatgaagaagaaaatgaaaatcaaaagaagtacgacggacacgttagtatgcctttgttgccaccgacaacgcccaagtcaagacggtcggaggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgagctggagacggagcttgctccagcagtgcagacgccgccacgtcgctatcacaacagatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaatgtggtagtacgagttttttctccgcaatctcggagttagtgcagccgcgcccgctgctgcaccctttagcatatatataaagtgcgtaatgtgcgtgctaaaaaagctcactagtgcgtactctgcttatctctgcgtatccgccgatcaacatccgcggctaaa

SEQ ID NO: 313 - DNA, 1000 bp, Saccharomyces cerevisiae
ccatattttggagaagagacgtcattcaattaaagagtaaacagcactgggcaatattagggcgttccattctacctaatgctcaaccattaaaacgtaaaaagtatctaccgatgagggaaaggatggtaagaaacctagacaagtacgttatcaaagaattgttttcgtatgagcaaacaatgaagtctcctaaataccccagcacgtattgcgatcatttaggacaggaacatgtgataacagatttgtcgcattataaaaataaatttggcaacatcgaaatttactcgaaagaaactaagcctgatggatttgaattaataccgcttagcaaagaagttgatattaaatgcctgataaaggagtataacaaaggtaaaagaaagatgcaaaaaatcaagtatttggatgtggtaagtggatttgattttaaacagaaaaaaggccatgccattccgaaaattgaaagcattctagtcaaagagacagactataaagcagtccagcttttgaagcagcaaactaaagtactactgggactctcgttctgggacattctattaagaaagctacgagttaacgatcgattaaatgctgagtacggtaatgttggaaataatgaagaaacgttggacgaccattgactacatcgtatttcaccttttctaaagtaaaatggattcgacgctgtttcgcagagggtataaatgtttgcacgatcgatagagcgtatggaagcctgtgcataatcatatctctggagaaggaaatcttcgataagggccagtgaaatagcggagtatcatggaatccgggtaatgggcatcgaagcagctcaccgaagagaagaatagaaaagaaaaagtagaactattctcgggatttatagtaaacaggggacggacgattaagaaataacctgatcaaacactgtacactactgctgtttttttttttttttttctgctagaaaagaacatatgaagaactaaagcgc

SEQ ID NO: 314 - DNA, 1000 bp, Saccharomyces cerevisiae
aagtctttacaccacaagatactgacaatggttatttgatattcattttatggtctgtggccgctttagctgcctttagggtggttggttccatggcctttttgttcatgaaatacttgcgtataatagtgagttacagaaataaagttgaaggtagcggctcatgggaagtctctaaattagacttaccaaatgttttccacaaaaagggctaatgccagtatttttcagctaatttctcgtcattccctcttttttctcattctgttttagaatgtacaggttatgacaaccattaccttctaggatattttgacatttctctcttagactttttatatataatatacatgtttcaataccaaatataatgtagcataacataatctatctttttactcatagacctttactttcctctctaaaagccgtgtcgcagtaactggtgacgctaaagttctccggcgtttttttatgtatgagctgggcatcaagagcttttgagattttccaagtagtaactcatctttctgagtgtgctatcaaatacatactaaggagaataaactcttgttattacgtattcttcatccttatgggtagagagcgcactgttttagtacattttctagacgtcgaaacgtagagcaattgtcgataaaacaaaaaaaaagtaagaagatatatgaataggagctgtcgctagaactagtaagtatatgatggagatataataagtgaattattcgatatttaatgaacgttctcatttatttggaagaaatgtttatcacgtgatggagaaccaatgagcggcgagtaactacgcgaggaacccggaccgcaataacgattaaagaaggcccggaagggagatgcttaaatgattatcactcagttaaaaaagacaaataagaaactattgagactgaaccgttttggttaatttcaggtggaaacaattgaagacgagcagtaaacattattttatttagtagtc

SEQ ID NO: 315 - DNA, 1000 bp, Saccharomyces cerevisiae
gcacgagaacaagaaatcaaagattatctttggaaaattttgaattcaaaccgtgtgatccccggttatgggcacgcagttttgcgtaaaccggatcctcgatttacagcaatgcttgaatttgcgcaaaagaggcctattgaatttgagaacgacaagaacgttttgttgatgcaaaaattggcagaaatagcgcctaaggttttgttggaacacggaaagagtaagaatccatttcccaatgttgactctgcatcggggattttgttttatcattatggaatcagggaattattattctttaccgtcatttttgggtgttcaagggccatgggacccttgacacaacttgtttgggatcgcattctaggtttaccaattgaaaggcccaagagtttgaacttggagggtctggaagcacttaccaaagcaagcaatgttaacaagttgtaacgcagttccaatttacaagaatgcttcgtttgctattacaatattgaaatataaataaaattccatacagcatgtctaatcatagctaatttatacatattcatcatgaaaacatataggggaaaatatggtcggttaacacacctatcaaaaaattattcagcaattccaatctcgttagtaaaatatattcttattttttttttttttctctgattgtattatttctggagttttgacttatttttttaccacatcgcgcttttcgtccccaatctctctgatatatgatgctgtctataggtagccacttccccgatgtcggacctcgggccgtttacaaactttattgagatgaccttatttctccacattctagtcattcaacttttaccctcatatgtttaccttcactaatgtgaaagcatgaccaaagaaagtgtataaggtatataaatctgccataatgtatgtataacttattaggactttctcaaatagtattttggtattttctactgttctctgatgatcgagagcaaacaga

SEQ ID NO: 316 - DNA, 1000 bp, Saccharomyces cerevisiae
atgttctgagcattgagcatttaggataacagtgcacaagatcacgcggttcaattcgtcacgtaaagctactagaagtgggtgtttctagtagcctgcaaaaagcgtcgttctaaagaaacttttttcaatgacacatttactgaaaatagaaaaagactatctattcgtagctgattttcaaaatccgtatgggaaatcagaggttatggaactgacaacgtcgtaggaacaagcgatatgcaaatcccggtgtcgctttgtttgtgtatcgctaaaagcttatatgcaatactcgcgaaggtactataatcccttggactaggtcatcccaattctttgtctttatcagtaaactcttatcttacctttggtctcaaactggtattttatttgctgaatattaactaccactagggattactcgtaaaattatgaaaaaagtaccatatgaactccaataacggtaagtgatcaatagggaacagcaagtctcttcttctttgcaacgtcaagattgatcctatgctttcataatttccctacatgatggcagtcatactccaattaagtgctacaagaaagaggccttcgcaacaactgtgtcaacgcttgcaagtgctaaattgtactacagcaccagtggtatctcctatagtcagttacatagtaaaatattcagaggtccattacataaatatatatatatatgtagaggcatccatccatgtttgtcgatgcagctgcaagcacccaacaagaacagatgacagccaacagtcgttgactaacgtaatgggccactgctgagaagcatccaccgcccatgccatggttggaatcatgacaagtcgccctatataatgccttcgttctttaatattgacgcgccaaatgtggcaatacgcgatatttttttcgttcgtgtttaaataaagagcaatataacacacccttcaccattcttgtagaacatcgtctaccagtaacacaagtaaaa

SEQ ID NO: 317 - DNA, 1000 bp, Saccharomyces cerevisiae
tctctctttggtaattctccaactcgacgttgtaagcctgcttccatttttctttttcgttatcactcaattccttccatttcttggagatttcttgagtaatctcagttgaggataaaggtggcaagccagccttttgtctgtcttcacgaagttcttgacgaacgtacgcagagtaagcaaagaaaacagtcagtggcttctttggagcatttggatcacgttcgatctttcttcttacagccttgactggagcagcgataatagcatctttatcatcatcaatagggttaaccagctccgagctgatgccgtgcaagtggtttacaccagaagtcaatgtttgcaaagactcagtcaaagtggtgaaagcctctatcttctcttcttcatcgtcgccgatggcattgtagaaatcaacaatagaggaggctgtctgattagcagcttttgataactcgaagagggaggagacgagggagtctttggcggacttcaatttgacagaaggatctgtagtcatggtgtgacaggcttgttgtgtgtggtaggatgtacatcctagagtataaggcagtagaccagccctgagggcccgctgggactaattggtacttcttgctaagttcttgaaggaagagagtgttccaggcagagttgccccccgtggtactggagagaatctgagtgaattcccttccggaagcttctctccgccacaacggtcggatgaaaaaaaaaagcgggaaaaaaaatggtgaaaaaccacgttctcgaagccaattggtagataatcgagtcgggtaatatttctcagaagtaggctgggtaactaagtatctcaccaaaatgtctttatactgtatacaaatggtgggacaaaatggaataagataaagccattggagatcccttttttaccagtaatcagttaaacaatttccattagtagcttacatggatatgtgcatacgtgtgcctaagtagaaatttttttcac

SEQ ID NO: 318 - DNA, 1000 bp, Saccharomyces cerevisiae
tcttggggaagaaaccccgtaagtctccttgtaagccttgggatttggtgtggagaagtaggttcttcggttatcatatcattggtagtactagtactagctggcggcattgttcaaaattaaattaagttgaaagctgctttactgaaattgtaatgtagagaagtcaaaaaagatccaattgtttttcttttggatatttttagtaatcgttaccttctcaatctgtgcttactttatattacaatagcaagcagaaaaaacttataatacttcgtacgtaatcaaaacaaaaggtacaacaagaaacgggaaggcacaaagaatcttgctttactgctatacaaacttcatgctccttttatacatataatatattcgtcggtgttccttccttatctttgtagcatgcacatggtagttattaacctcccctgaaacttttttagcgaaaattatccaccccttacttatttcctcgagagtctctaaaaagtaaaaatacaataacggtaattggggaaggcgttccttgttaattcaaaatgttatccttgaaacatagaaggtgctggctgcatctcgcagagcttcctcttccgttgagcgttgtattcttccccccacagtgctactaggcgatgccgctaccccttgaagggccttcccgctgtggggcagcggccttttttccttagtgggaaacaagcaccggggtatatttcattgtctatcaggagaagagatcgtatacaaatgttcgtgagacggtttcatcttgactagttgccttgctagtcggataactagtggaaagcagtaggacactcccgatgagtttgcgtttccacggggtttgacagagctacctattgtctttttcatcgaaggaaacggtagttggaccttgccttggataagttggtgaatcatccagagctttagaagggagcaaaaaataaaatctgcgcaagcccggaatcgaaccgggggcccaacg

SEQ ID NO: 319 - DNA, 1000 bp, Saccharomyces cerevisiae
ccattgtcatgcgtcattcagaagaaatgtctgttcatatcgccgctaaatattctcctgttccaattattaatggtggtaatggttctcgcgagcatcctacgcaggccttcttggatttgtttacgattcgtgaagaaatcggtactgttaatggtattactgttactttcatgggtgatctcaaacatggtagaaccgtacattcattgtgtcgtttgttaatgcactatcaagtcagaattaatcttgtttctcctccggaattgaggttaccagaaggattaagagaagagctaagaaaagctggcttacttggtgttgagagcattgaattaacccctcatatcatctcaaagaccgatgttctgtattgtacaagggtccaagaagaaagattcaatagccctgaagaatatgcacgtctgaaggatacttatatcgtggacaacaagatcttggcacacgccaaagaaaatatggctatcatgcatccattgcctcgtgtaaatgaaatcaaagaggaagtggactacgatcatcgtgctgcttacttcagacaaatgaagtatggtttgttcgtcagaatggctttgttggccatggtcatgggtgttgatatgtgaatgataagagacctatccgtattttaaatttataatctattattaaacttttttaaccaatatttttatttgtatattacactcaataatatgatttcccaaagtcgagtttttatttaaaacaaaagatggaatgattttgtaaacaaattttcttgaggaaacaaaaaatgtttaaggcataggagttgaaggtaatctcgttccttttgtctagttttcatcctgagctcttgaattttacctgaattttcccgcgacggtaagaactttaagggtctaaaaaagtaagttcagaaaactataacagctatatatcacaaaatgcatacctgatgcatacacagtaaggaggtaacatcaggtccgtggat

SEQ ID NO: 320 - DNA, 1000 bp, Saccharomyces cerevisiae
ggtaaggatggtgacagcgaggggaaaaagccagctaagaaggcaggcgggacttcgtggttcacttggttattcctatacgctctactgtttacattgatatacctgatggttgtatcattcttgaataccagaggaggctcttttcaagatttccgtgctgagttcattcaacgttctactcaatttctcacttccttacctgaattctgcaaggaagtggtttcgagaatcttaggcagaagtaccgcccaaagaggcggttatagcgccgtttaaataagtttactggcttacaattcgatatttttgcaacagcagtgctaaccttttattatatttatataaactctaagcttttatatctacattatactaataaaaaaaacttgttcccgtagtaagttttccggctaagaaaggaaaggctattgccgctttcttttaattcttcatcaatgcctttagattgtctattgttttttcaacagtagtttctaaatagttcttctttatctttaatgtttttctttgatccagaagaacagtttcgtcatgtgataaatcattaacgtatttggatttatcctgtaagataaacgatttaccgcaagatctccatactttgtccgttggataagactctagttctttctttgtcaattcagcaagcttttcttgtctgtccaaatatgctagctgctgattgaccatatccaattgtgtcctggcgtttcttaagctcactgtcatttcttgtgctatctgtgacatgtttgtaagtatgtattattgattcaatttagtaaagagctctgtagatagttctttaattcccatctgctcatctgagaaatttcttcactgttactttttaattgctatatctttaaactcattcattttcttcagagaaaagaaaaaaattaaggtaaaggaaaaggctaaataagaacaaaacacttgaaggcaaacgaaaccctacaaaagagaatacgga

SEQ ID NO: 321 - DNA, 1000 bp, Saccharomyces cerevisiae
caccacatgtcgacaacggtttctggtccgataacattgacgagttcaagaaggacaactacaagatctttagacaattgatcgaactcttgcaagcaaaggtccgtaacggcgacgtcaacgcgaaacaagaaaagatcattatccaagtcgccttgaacgacatcactcacgtggtcgagcttctaccagagagcatcgacgttctcgacaagactggcggcaaagccgacatcatggagttgctgaaccattcagattctagggtgaaatacgaggccctcaaggccacgcaggcaatcattggatataccttcaaataaagatatagaagaccgtaaagtagtagtgggtttgaagcctaaataagtagttttgtacgtactattattttaagagaagaacatccatagaaaagaaaagaagaaaaagaaacgaaccagaagagggtagcagaatcagtcattcacgcacccggcctgcgctgcgtgcaccgactgcgtgcgtgcgtgattggtaatgcagtgaatcatgctttttcatgacgcctcctccccgcccctgagccttcggtggccgccgaagtcgggtattaatgggcgcccctttcctggtgtccgggaaccgcctgccgaaaaccaccctccgcaggtccgcggaaggtgggtgtggctgtccccgcgcaaatccgagatcgattccgcggcgggtcggtcattcttttcatttgcgcgctaatatgcgctgtgactggcggttagtcatctgcgtgatcaatcgttgtcatgacgctctataacgtaagagaactttagagggggctcaattagcatgaagaacagacacatatataaggtctctagatttctccaatagctcaactctcacaattgtttcctctagtccttgtaaaatataaaaaatcatcatcaaacaagcaactacaaaacagctttactgacaactcacacaaataacacaaaaaacaaaaatttcaaca

SEQ ID NO: 322 - DNA, 1000 bp, Saccharomyces cerevisiae
gtacttgacaagagatgtaggggcagccatagagcgtaaaaagaatctacattttgataaaatggtgtacgtgatttcctcacagcaagatttatacatgtcccagttttttatgatattaaaaaaaatgaattttgaatgggcaaaagacttgcagcatataaattttggtatggtgcagggcatgtcgaccagaaaaggaaatgtggtattcttagataccatactagacgaggcaagggataaagctctgcaaattatggaaaataacaaaatgaaaatatctcaggtagataatccacagcgtgttgcagatttaattggcgtatctgctatcattattcaagatatgaaatcaaagcgtatcaataactatgaattcaactggaacagaatgttgtctttcgaaggtgacacagggccctatttacaatacacacattccagacttagatctttagaaaggacctccagcgactttacgacggacatgctaatacacgcagatttttcaaatttaaatgaaccacaactagttgagcttgtgaggttgctagcgcagtatccagatgtccttagacgagcattcgaaactcaagagccggccacgattgtaacatatttattcaaagtttgccatcaggtctcctcgtgctataaaaaaatatgggtttccggaaaacctgcagatattgccataccgcgactcgccgtatattcagcaagtagacaagtgttacacaatgcaatgtcgcttttgggactagtcccggttgatagaatgtaattatatgaataagctagcaaatgctagattaatttagattaagtttaaccaatttataaacatgtaaatagaagaaagtttattgttacgtacaacgtgatattttccgattttcctttaattgattcttgaataacccacctaccgttagttgaaatagaaacaaagaagaaggatatgcaagtttatattggacaacataaccaatagaag

SEQ ID NO: 323 - DNA, 1000 bp, Saccharomyces cerevisiae
gctaagtcgaggcaatctcgcggcgcgactactttgaagcctttttttagttcttttttatgatcaaaatgtttatataattacccagattatcaacccacttcgatgatgggccgcacctgacagaaaaaaatgaatcaactggctactaaagatggtacaaaagttcactttattcagatatagaattgctgaatcgctgcttaccgccatacgcttgactacttttacacccgtacaccacacatacaaccgtacgactacttttcatgcaacagcgtgcgtttcgacatgtcttacacacgagtagatcatcccactggaaaaatggcttgtcacctgaggcagattttggcaagcccactgtttttcgcaaattatgtactacatgcagccattcactacccttcgagcgacatacgcggcgacatcctgtagagcaatgttgtccttaccaagacgtcttgatgaaggataagcatacgcgaagagatttcctctcggagagcctgcagggagcggcgcacctcgccagcggagttatcacacgtaatggtactgagtgagagaccccgcccgacaccgcacggccatttgcagaaagaaaaacaaagtccactacggctaattactgcagaatgcttttttttctttttttttgtggttggtatgttcccttctaacaggattcttccttcggtagatccttgaggggtttaaggggttttctgtttgcgtaatggcgtaattgccagctatatataacattatcatcacatatatatccttatacgtagcttgcccttatatatatattgatatgcggatattcgttgaatgtagttcagtcgtaatcgctacttattggtaatcatagcaattgaatgcttctatattcctttcttactttttttaattgcgcattataaaaaacttgaaggtgcatatttccgattagggccatcaatagtgaccataattatcggtacattaatacgtc

SEQ ID NO: 324 - DNA, 1000 bp, Saccharomyces cerevisiae
tatgacagataacacaacttccagcgacttaataaagaatgtcgaaacggctcgctccactatcgatggtttaattgaatctctagggtggattgaactaaattaccgttgtgagagacaatgcaattgggatgaagtttgttacactccttcctggggcccatctccaatgggtatgactgaaccaggttcccacaatgagggatttggaacccactttgatgaatctcgacaaaggttggttattaacagtaaactacagtgtatcaatataaatgatttgatggttaatcgtaatcattagcgcctcctgtgagaaggccattgtgggacagtataaagggtatgatttctagataatctaataatgattatgaagtttttgagatttggggtgatacacatctatgaattactaagagatttgagacacagcgacagtcatgccagcaagatttaagattttctttatttagtgtttatatacatatcagatatctgttgagtattttctattttaccaaaaaaaaaagatatgaaatcaagataaaacgtcgtatgaaagacaagggagctcagcagcaatatcataaagtaaagcaacagcgcttggtttatgtacaatgaacgatctgaaaattagttggcagcggagctacgaatacatgtcaatattacgttacgattgtataacaggggaggagaatcgtgcactttgatgggtatatcgaaagatggtgactatgctagagtcactgtcagtgaggagttgcgatgtatgaaagattcactgacataaagtggcgcgattcatgtagaagtgtaaatcacttttgacgcaatgatggaagagatacagaagagatacggaaaaaataaaacaaaaaacaactgaaataagtactaatggattatatttattgccgccattattatttagcctctggtggctcaagaatctgcagttatttaattatttaatcgagcgtgtaatgctctg

SEQ ID NO: 325 - DNA, 1000 bp, Saccharomyces cerevisiae
acaaattatgtagtgaagatcaaaggatatacacacaaacgaagatgcgcattagccacgtccatccctttccctttttccctttctactccgtttttacaataatgtacgttataaaacaagcggctgaagaacaagttgggaataaatgtcagcaaggaagattggtgtaaagtgaaatcagataagcaacttaatacacaacctcaaaaagaaaaaattaccatgtcattcatacctattgtatgtggtatgaagagtttcgactcttcatacgataccgttcccggacatcaaaacctgtattgcccgaattgtcacaattatagtgtcggccccataaaaagaaaggaatttttcactatttggtttataccgttggttccggtcttctggggaaaacagttgcactgccccatatgcaattggcgacaagattttaagaatgacgaacagcttaataaagtcattcaagaacaacaaaacttacgacaaaagcagcccaactgataacgaaataatttccttttcttcctcttatatatgtatttatatatatgtgttcactataaccatacatatattatacagaagtatagacacgatttttccatacgtaacaaataacatcacgatgcacgagcactgtttccaatggagaacaagcgaaaggcggtaaatgcgctatgctgattggtgtagagcgcgggccaatgagaaggccccactctcagagggtgaggtgcgattatcggggacatgtctccgtcgatcgggcccacgtcgtcgcacaatataaataccatttgagtttttaatattaatttttcacgacaacccactcaaaaaagtatatattcactgttagttatacggaacattgcaatacatctacaagtcaaaggagcccctctatattatttatatttgtcgttgttcttttttgtgtgctcttttatacttcagaatcatacattaacatacatataagcaaatagcc

SEQ ID NO: 326 - DNA, 1000 bp, Saccharomyces cerevisiae
agaaatatttagcattcttcgagtccaaaatctctatatattccgctcaaagaagtaagctatcaataatgatcacaagtccaatggcagagaaggaaattgcaagcaggaaaatgttccttcagctagaggcctttctgaaaataaacggattcgccataaaaaatgaagacttgaagaaaattgtcgaacattcaaagggaaatcctattttacttgtaaagaacctttttacttattttcgtaggagaaatgaagttttcaagctcggaaccgttgtattgcaggaaatattgaaaatcatcggaatgaatcttaagcagagatacggctctatattagggttttcttcccaagatggtgaaggacaagaaatagaaaaattttggaacaacgacacaagtccgattgttcctcttcaggagcttcctgaaccaaactttttccgcaaggccgcattttgaaccgtattttgctcgttccagcctttccacgtttttgttatctaagcaacttggcacatttccctactatactacaaaccgatacgtaaatacttccctaaatagcatatgaattattcagtaatttttaaggatcgaaactgcacctcaactattcgttactgtggttatgttctcatgtattgatgcaaatcatgggatatttgctcaagacgacggtaaaatgagcaaaaatggcacgatcctgaaaagagcacttttcaagattcgggctacaaaatgcaacataaaaaatgttgtattgtcatctcgagagggtcttgtatgttttattcctcttatgattagttcacattagtaaaacagatacgcagtgtgctcttaataaacaactactccatagctttatttgcataacaaaacttttaagcacaaacttaaacaggtggagtaatagttcggcggcgactcaaattacatttgttggaagaatcgaatagaaaataaaaaaaagtgtattatatttgacattcaaa

SEQ ID NO: 327 - DNA, 1000 bp, Saccharomyces cerevisiae
cgctggcccaaatataagcgtgcgccataaaccccaaaatggaatatgctcttctgagctccctgacgtcgcccaagatcgtctcatccaagtccaagacatccagcccatcgatgacgctccgcaccttgttatcctcttgcaaaagagagggcaggtcagcaacgatttcttcccatttcatatatttcttgctgctcagtctggtcaagggtaaccggtcgtccaaaaacccatgatgtggcgagatacagtatttttctagcactggtagtggtctcatttttgttctatgtagtacttgtggtccggttatggaagtgttgttcatatcggcgttgactctttcttttattttcgctttatatatgctaaagatacatggacatctagtgtgtgtgacagtaattatttctgacggtggcttttttgcctcggagcgacgttgaaaagtgacagcgtcagcccatagagaaaaaaaataaaaaaaggccgctaccgatatgttttcattacgacaattaagcagcacaagtgtctggcgcaatgcctgactactgggaaaagtcgaagcatttgcacggcgtccattacgatggttaaggcagtttacgacgaattgcggagtcaagttttaatatttatagatagccctgtcaccagtatcgggtgttgtttctacccaagcgcctgccagcctcaaacaatacaacaggtattgtttttggacagcggaatgctgcgatgcaacagtatcgcagcatggtactgctttcctctagtcttttgtcgaatgtgagcaagcagcagctgagactctgcccaaccatcgttagccaatcagcgtcgagaacgggtcccatgcccggccgcggcccgtttcgagaagatttttaagtgcgatccatcctcccgatctttttatctacaagaaccatcgcaaagaacagagtgatctgcaagaagaagaactacaaagatcaaaaagtctcatctcacc

SEQ ID NO: 328 - DNA, 1000 bp, Saccharomyces cerevisiae
attggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttgctaaagctgaaaagttagccgctgaagccaactagaagaaataaagcttaaaccaagggaagcaaaatttgaaataccgaaggtagaacaataaggatgatgggaaaaaaaagataattttttttttttgtttttccctgcttccttcttgtttattggtattattatgttacgatattcattcattatcctattgatattttctttatattcactaaaaaaaaatttattctataagactgactataattttttttactcccaactgtaagtaaataaagactcacctacgcatacattttttatatatactataagatgtaggatcttaaagaaaaataaagagaaaaagagaagcacacaacctgcgataagttgtaagtttgcctcaacagctattctactcactttttgtatcttcggttagtattattgggaagtcatgttcatcgtactcactttcgcacatgcgattacgtgtattaccctgattttctttctgtattagcgtatggctgactaatattcacttggggtcaacataacttactttcacatatcatggtagctgttttaattaccattctattagatgcgctgtattccaaattaccgttctctcattgagcttcttccttaaaggttcttgcctcgctttcccactggac

SEQ ID NO: 329 - DNA, 1000 bp, Saccharomyces cerevisiae
caataatgactaaaaggtgaaaattgaaaacattaccttcatttttttacggccggagaggggtaggtacacttaaccccgagcgcttttagtgccaaaaagagttaatgtgcgtagtcggattttaaacgaccatgcatgtacagccccctagtgatttatactgatgcctcatcaagaaattttttcatccagggtccctgctcggcgaacctttccgcaagagtcacaaaaatcaatcttataaccaggcaccagtagtactgccaagcttggactacatagccaacgtaaagacaaggagtctgatttagtatttcttttttgccagccagtattttctgcgcaggatagattattttaagagccgagaattccttatgcgggcccggtcacaacggattataggttccgccagaccccgttgctttggttccatggagcaggagcaggattttccgtggaaagagaagcaccgagcgaaaagcggatacggaaggcggatgcggaaacggatgcggacgcggaaggaaggaaggaagcaaacccttccgtctatgtcgctatgaagccgtctcacagtagagccattcgagatttccgtccgtcggtacacagaaatcttcgtatcgggagttttactttaaaaggaaacgatcgtaggaattccctaaagaaaaaggaagaaaaatttaacgttgaacattgtcattttcttttttttttttatgtgtgcagaatatactatcaagtaatgtgttctatatataaagggtacctcatttgatcttgatgtttctttctgctcgtatgccttgagtcaccagttttcaaaaataatcttggtctatagaagagaaaaatccaataatctgaaattggttcttcgcacccttgcaacgagatcatatactaaatatcgggaactctttatttctggatcttttatcagtcacttttttttttagtcaaagaagcaagagaaaactagacagagaca

SEQ ID NO: 330 - DNA, 1000 bp, Saccharomyces cerevisiae
ctctggcttagagaagtctctaaatcatctaaaattccatgaaataatttaaccttctctttcaataatttttgctgagattgactgaaaccattgacgagataagaatctagttgtacattttttaactgttgttgcatcatcatttctgctccaacttttaggatgtcatcgaagcaaacagtaagcttatttttatacgtcattgttctggtattgctcccccgttcagagaaattggctgtgtgaacagacgaaactgggctattttgtactaccattactttcagacgggcagtttatttgggaggatccgccttcaaatttaaactatcttgagaccagaacatctattgaaattttggtgaatattccagcaaccctctctatcccgctttgaatttcttgatgtcattggaaacatttaacttttctcgttacaagcgggtaatatcctaatcattgtaattaagacgttgcttccctgggaagaaaatagtataaacataagatataatagtttttaaaatggtcaacgtatgcgatgcacaactaaaaggtaccaattcattaaatattataatatttacttcttactattacacgaaagacaagtgtgaaatgcctaggagattgatgattgacaagctctggccttgcaataaaaatacttatacacaacttcaaataatatagaaaagaaagaagactataagctaaaaatgtagacaacctcatttaaatattattcttaggacttggtaataatagctaatttgtatattattcacctcggtcaccgcctgtaatcacctttaacgaaaatagatgcccagccaatcaaagcgcattatggagtcgtctaggaaggggccgtcccatcattgtaaaagttcatgttaaattagatggaggataacaataaaggtatcgtacacacactgctaaaagagcctcaatcaatttgtgaaggtataactgtagccgtgaggataggaaa

SEQ ID NO: 331 - DNA, 1000 bp, Saccharomyces cerevisiae
aatagtactctcatcgctaagatcatttggggttgttaagcatgccctgctaaacacgccctactaaacacttcaaaagcaacttaaaatatttttatctaattatagctaaaacccaatgtgaaagacatatcatactgtaaaagtgaaaaagcagcaccgttgaacgccgcaagagtgctcccataacgctttactagagggctagattttaatggccccttcatggagaagttatgaggacaaatcccactacagaaagcgcaacaaatttttttttccgtaacaacaaacatctcatctagtttctgccttaaacaaagccgcagccagagccgtttttccgccatatttatccaggattgttccatacggctccgtcagaggctgctacgggatgttttttttttaccccgtggaaatgaggggtatgcaggaatttgtgcggggtaggaaatcttttttttttttaggaggaacaactggtggaagaatgcccacacttctcagaaatgcatgcagtggcagcacgctaattcgaaaaaattctccagaaaggcaacgcaaaattttttttccagggaataaactttttatgacccactacttctcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatctttcgagatcccctgtaacttattggcaactgaaagaatgaaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaa

SEQ ID NO: 332 - DNA, 1000 bp, Saccharomyces cerevisiae
cgggatcgatgtggctaagaccgaggagaaactacgcacctacgaggaattaaacaagcaactgattatgaataacttggagagaagcagaacagagatagaaagtttcgaacagagacaaaaattcgaaaaggagatgaaattgaagaagcgactgttggaaagacaaatcgaagaggaggaaagaatgaacaaagagtggacaaagaaagaaatcgtcaaccggttgagtacgaccacccaggatatcaatgaaacaatcgaaggcgttaaaaatacggttaaattgaaaaaatcgtccgctagaaggaaattggaagaactaaatagagttctgaaaaacaatccatatttcaattcaaatgtgaacgtacagaattcgagactcaaagatgctgtaccgttcacgccgtttaacggtgatagagaagcacacccaaggtttacgttgaaaggttcagtatacaatgacccattcatcaaagatcttgagcacaggaaagaatttattgcgtctgggttcaacactaattatgcgtacgaaagggtgttgacagaggcatttatgggcttaggatgtgttatatccgaggagctttaaaacatcaggatagtgtgcaacgtggcataagctatgtaatcaactactttttattttctatgtacgcatatacatgcattcacgatctgtttcagtgttcagaaaaaaggcacctactgctacggttggcccatacctttattctttgttcttgttacaaacgagtgtgtaattacccaaaaaggaaatttacatgttaaatgaaacccagtaatcagaaaaaacagttaagaaacctaaaatggtagagataaagatacagattcagtggttgctgaaaatcaagtaaaaaaatgaaatagagtcttcatatataaaccgccagaaatgaattaatgagagggatctgtaactgtttctcggataaaaccaaaataagtacaaagccatcgaatagaa

SEQ ID NO: 333 - DNA, 1000 bp, Saccharomyces cerevisiae
tccacctccaaatagtgcgccttcttggtttcttctgtgttgctatttccatagtcgcttaaatcactttctccatttttttcattgtgttgaaataaagatgcattttcctcatcttcaatatcgaagtctttattgaccggtttaatggcgatatcggaaatttgatccgctagtgatttttccatctttttttgctctatatttattggtaacagtgcttattgttactcaatgtatggtacgctgcatacctatcaagatgcgactacatatatacaattatctcatctcatcgcgtattgaaaaattttccatcttctaatttttcagaacccataaattcgggtaacgatcagtggaaaaaacttaaatccgcagtaataggcttgcaaaggaccaaagacagcatatgcagcagttaagaaatctaagaatgcattgtatattagagtagtatatggaaaagctcggactgggagccgtaaaatctctttcccgtaagatctggctgcaaacctggtctacataaatgtagtacattataagggactaccaagaaatacgaagcgctcagatatctcttaaagttcatttttttgccggaataatcttggtttagtaacttataaaactacttacgtccaataaatcgttatattttatgccgtcgtcataaagtggacactttcgagagacggtgctggccaataagatgctgatatttgaaatatcatttacccgggcccgggtgggaaaaacaaggaattaaagataatgaagtgatcttttggcgagatagtaaaactttcaattatctaggaacaatttcaaacgccaattgttaactttgtgtacagtatttctagtttttatctcattgaaaacaaaattcagtcaacttggaaatttaagcaggctactgtggcattgagatatttttccgcagagtaagaaccgattagcaagttaccgcattatttttaaaccgtggacaatc

SEQ ID NO: 334 - DNA, 1000 bp, Saccharomyces cerevisiae
tttaaagcagttttattccgggtcctcgatagaatttactttaaacctaaacgatgaatgtgatgcatgccatggtagtggctctgcagatggtaagctggcccaatgtcccgattgtcaaggtcgtggggttataatacaagtgctgcgcatgggtattatgacgcagcagattcaacagatgtgtggtaggtgtggtggtacgggacaaattatcaaaaatgaatgcaaaacatgtcacggcaaaaaagttaccaaaaagaacaagttcttccacgttgacgttccaccaggcgcaccaagaaactacatggacacaagagtcggcgaggctgaaaaagggcctgactttgacgccggtgacttggtcatagaattcaaggaaaaggatactgagaacatgggttacagaagaagaggcgacaatctgtacagaacagaagttctttctgctgcggaagcgctatacggcggatggcaaagaacgatagaattccttgatgagaacaagcccgttaagttatctagacccgctcatgtagttgtctccaatggcgaagttgaagtcgtgaagggattcggcatgcccaagggtagcaagggttacggtgatttgtacatagactacgtcgttgtcatgccaaagactttcaaatctgggcaaaatatgctcaaagatgagttgtagacagataatcctacgtacgcacacatgcatatatagatagacaactggtcttctgcatccggtaataggcattggctttaatactaataaaagcaagaaaaaagcgacaccagtaaatttcagacatcttcgagaatttttttcgcgcgctttctatcaaaaaaaaatgaaaaataaataaataaacaaaggaaaataaacaacaacatatactgttcttatataacatagaacatctattgtttccgtgttttgctctttcctgcttttgttcgatcaaagatcacaggtctcaaagtcgtttagctagcg

SEQ ID NO: 335 - DNA, 1000 bp, Saccharomyces cerevisiae
ttgccttgtgtaagttagaagtacttcttgtcgattgtgaattcggatagccgctagaacgccaatcattgcggaggtttgccatcgcatggataccatagccatctgcacattctaatatagattatattactttagaccatgtcatttcataatcgttggtttaagcggtgttgtttccacagtttgtatgagaacttttgtccaaagtaaagtatcagtaacgtaatctgagcaaacctacattaaatcgtaactccgcgagattcttttgttcaggtggatcagcggcgtggtttacttccgatttgctcatcgtgcgcatagcagcatttattcctctaattcgctcgataatcaacctttccgcactacgacggtggcaatagttggaccttaagatatgcctatctgaatacaattcttcaactcacatcagtgggacactaaataaagcatatggtatgaaatactatgaattattgaattattggcagacacagcagcgacaagtcagagtgcttacaaaaaaaaaagagttgatccggctaaagaaagtctgatttacgtatttatccaggttcaaacggattgccaaaaatagtcgataacctcggagtaagcaaagcaacaatatatttgttcttcgaaaaggtaaacttcttaacttctatagaagcattgtactagttctctcgaagaaaaaaactaagaaagctatagctgtatcttaccaagccatgaacttgaggaattggtaatccttattaggaaatacgctaaactaggtaatagcagatgatttactagcttactatctcacactaagtctggcaacgcgcttattttttaatacttttatacgaaccaatgaaatttgatcctcccctttttcgtctagttaaatgaagagatacaagtaggcctttctattgagtacttagcaagatatgtatttctaagaaacatcaacagtttcagcccacaaccgattcataaa

SEQ ID NO: 336 - DNA, 1000 bp, Saccharomyces cerevisiae
accgaggcggacgtgagactctacccaacgatagtaaggttcgacgtggtataccatcaacacttcaaatgcaatctggccaccatcagagatgattattcccgtatacacacgtggctcaagaatatatactggcgccacgaagccttccagcgcacaacggactttacccacataaaactcggatatactcgctcgcagccacgggtcaacccgattgggatcaccccactggggcccaagcctgatatccgacctccatgaaatttttttttttctttcgattagcacgcacacacatcacatagactgcgtcataaaaatacactacggaaaaaccataaagagcaaagcgatacctacttggaaggaaaaggagcacgcttgtaagggggatgggggctaagaagtcattcactttcttttcccttcgcggtccggacccgggacccctcctctccccgcacgatttcttcctttcatatcttccttttattcctatcccgttgaagcaaccgcactatgactaaatggtgctggacatctccatggctgtgacttgtgtgtatctcacagtggtaacggcaccgtggctcggaaacggttccttcgtgacaattctagaacaggggctacagtctcgataatagaataataagcgcatttttgctagcgccgccgcggcgcccgtttcccaatagggaggcgcagtttatcggcggagctctacttcttcctatttgggtaagcccctttctgttttcggccagtggttgctgcaggctgcgccggagaacatagtgataagggatgtaactttcgatgagagaattagcaagcggaaaaaaactatggctagctgggagttgtttttcaatcatataaaagggagaaattgttgctcactatgtgacagtttctgggacgtcttaacttttattgcagaggactatcaaatcatacagatattgtcaaaaaaaaaaaagactaataataaaaa

SEQ ID NO: 337 - DNA, 1000 bp, Saccharomyces cerevisiae
acactttcaaagtttgtggttgagcagtcgtagggtcggatggcttgtagaccagttccaaagatcctgggcctgggatcagtgtgtccgtagctttatattgatcaccgtgggcgtgtcttccaataatgattggtttttcccaacgtgggaccagtctaggaattctaggaatcacaatgggctctctgaacactgtaccgccgagaatgtttctgatggtaccattaggagatttccacatcttgtgcaggttgaattccttcacacgagcttcatcaggagtgatggtggcacatttgataccaacaccatacttcttgatcgcctcagcagcatcctgagtaatcttgtcggaggtggcgtcacgagattcgacagataagtcgtagtacttcaaatctacgtccaagtagggtagaatcaatttcttcttgatcttatcccaaatgatacgggtcatttcatcaccgtccaactcgacaacgggttgtttgaccttaatcttactgaaagcagcaaggcgagaggtggaaaataatcttctagataacatactcatgctgggcgatcttccttgtgcgtctgttgtctcacaattgcttgaaggaagatttcataagatcatatgagtccctctttatatgggcaagtggaattatgtgagtcaaaatccgcgcgtgacccgtaaagcgttatcagaaggtgcaaacggtgctatttagctcataaaaggaatgattcaagctcttttggattgtaagacacctttatttagtccaagatcattgcagacccttgttatggtctttagcagagtcctcctctatatctcttcatttactgcaacctgattggcccgctaccacgatgcccgctttgttcctgtggtattaaaagaatcgatgaaagagactcttatcttcagggaaaattaggaccgagaattagagcaagcaagatatttgcaaactactaactacaagcgacttacacagac

SEQ ID NO: 338 - DNA, 1000 bp, Saccharomyces cerevisiae
accggtttggtagttgttcctctcataaatttatttatcaagtcattgactgtatggttgaaactcgcccccatacgatccattttgttgataaagcagattttgggcttcgatttactttgcttccaaaccttctctgtctgtgcctctacgccggcaacagcgtccaaaatgaccacgcatgaatcaataactttcaaagccctaatcacttcaaaagtaaaatctatatgtcccggcgtatcaataagatttattgcaaaagtatttcgccatgggaatgaaatcgcagcgctttgaattgtgatacctcgggatctctcctgctctaaaaaatcagttatcgtatcgccagtgtcgacgtctccaatatgctttgagattcctgcataataaagcatcctctctgttgtggtagttttacctgcatcgatatgggctataattcctatatttctaaccttagacagtggacttcttgcggtcgataagtatctacttccaacgttaattacacttaatcggttcttgctaatgtttactcttgcgcccgcccatctgcgcacattccatttccacatagcctccctcacttatcttgccccttttgtatatctctgactgccgttttgccaccagaaagcttgttgatctatttcacattatcttcttttaaccgcccagcctccgcgccgtcgtcgttctctgtgctgattggttatctcccctctcactaagggaaggcctcaaaaattgtcgaaatgagaagaggctgaaacgatttactaatcatcatagcctgcttaaacgagttaacactaaggggaagggtacgactatcatttgttcggatctctgaaccggatattttctttgttacacacatcaagtttttgcatgaatagatcatatttcgaatgatttaacgtattacagcttagcaataaagggagtaaagaaataatatatttggatacagcatacaagaatatatatacat

SEQ ID NO: 339 - DNA, 1000 bp, Saccharomyces cerevisiae
cggccacttatcgtactagaagctgttttcaatgaagtgaccaccattgtaattactactgcaagaaaagttatagcctaccatcctgagcaaataaagttgcttcctgctcaacttttttttttccttgtatcattttatttttttcttggctcgcactgcgcaggtgacggtaaagaaaacaggccagctttcactttctatatatattactagtgcaaccgtacttattctcttgtaaggttaccgtctattcattccgctgctgcttctagtatccttagaatcgtaattgtttacgaacagtttgtattgaatcagctcctctcttctttagccaaataccgtcggtaaaatgcagttcatgggcacggagcagtgcgtcatcggttctatacggtaacttgacattgcatggataagatctttgatagtaacatacatctggctgggggaaatgcatggcgttcagtttcggggtttgaccttacttttttgaagaagactttactcaagagtgtaagctcccttgggggaggacatattacggaaacagggtgtccaaaaaacacctattgcgcttataactagtacattgctcaaatgaggatttttacaaggcttagcccagcccgtcttgtattgacaaagttaagcacctcaagctcacaccaaagtgggccctaagggtgatctgtatgccaaggctagcctaataggaaaaccaccaccggcagttacaacctccgttagcaacagagggggtgcctcgcaatagccaaggataagcccctccttgttactatgacaatcgcacttttcatgctacggccatttactaatgattttcacctcgtacccgctcgctccagtatggtgaaaatttaggggaagtggataacgttgaaatactatggcagaatccttatatataaaacgatcgttgatattttttacaacaacctaaaatgagagggaaaaggtaaatcaaggaagcatt

SEQ ID NO: 340 - DNA, 1000 bp, Saccharomyces cerevisiae
tcgaaaaaataaatgcgaattctgtggatcgaacacaggacctccagataacttgaccgaagttttttcttcagtctggcgctctcccaactgagctaaatccgcatatcagaatgaaataaacaagcattcttgtgctttataaatggtccaagcgtctaacttttaaagagtacattctaaaagtaagagacgaagacaacattataataattttctcaagacatatatgtttcaccggcacgttttgttttgtccccttttattttgagcctgaatactatgctttataaaactttaatgcgctcaacaagtgcaccttccaacggaaaaaaagaaattcaacagggagcgatgccatcatcacatgcacgttttcaagtatttataagacttgctacttgctcgtccattcatgactttaatgaggttctaatttattggtgcaactcttcaaactagctgcccaatcagtgctggaatgagtgccaagacaagcgacaaaccctgtcaatctcctgaaaaacaaaaattaagtgcttgagaagaccttcagaagagttgcatagataggatgggtgagcgcaattactagttacgcagtaagtaggttatatggctgctggaggggcagtactgatttaatcacaatccggattaaacttcctcctgaaaaaaaaaaaactacatcaagtcaaaagattttcattcactctttggaaggctgtgtggcattctaacctttatttttttatcaccattctcgaattttcgtggttcgctttcttagcgccgttattctctcttcttgtccacgtcaaagggagtatgcgtaacccctttcaaggttgaacgaaaaaaaaaaaaatatgtccttcaaaattttttttgatttaaaactaaaaaacattcccttgaagcttgttattccgaaagaaagaatctaaaattgcaattggtagtgaaaacaaataaacaaagacataaccgcactccaatc

SEQ ID NO: 341 - DNA, 1000 bp, Saccharomyces cerevisiae
agagggatgtttaaacatgtaaacatgacaatggtaaattttcgctagatctgtttgtaaattttctataaatttggcaggttggagctttactacgtaaggtttcccatctccccgtaaagcttttgatggaagccacttaaatttctctggtttacttatcattaaatggcaatctatttctgctaattggaaaacattcaggccatccggccagtatacgtataatatcctatttactataacatttcgcctcacgcctttctcaatcagtaagtctaatgtttctgtcaataaatatatgtcaccatcaaatgacccaccgaattttgcgaaccatgatagcgtaagatcatataataccgttaccggcagcttcatcaattgtttgaaaactactagtgtgtcggaagttggtacatagttatcttcaagccgtaattcgttagacattaattgctactcaaatatactagtcaaagatagtatccaccaaaatctttccccgctaaaataacgccagatgctttctatgcttctaatcttttaccatttacctttgtttatttcaatataaactttaatttacagtccctatctattgcccgactggactaacatgcacgtgacattttgtgatggtttttcgtcccttacttagtacgcttagtacgccacagtttatattttcttgacaataataaagaacctgattgtgggttagaacttgctatacttttagtttaaaataagcaggaaataatcttgagttctgtatcattattataaataaaactatatttgttctctttgtcgccctcggaactttcctcattacattgacgaggtatatatagatatagtagatatacatatctatccatggtatatatgtatgcatctggataattgaatagggtttcatgtcatatgccaagaatttgttaataatatagtggaaaaaagtcaagaggtattataaatttcaaaaaagtaccaa

SEQ ID NO: 342 - DNA, 1000 bp, Saccharomyces cerevisiae
ataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacagtctcgatccactgtgtgtattcttggaaaatgaacaaatcagtgtagagaagtcgtcttcgtttccatcatgagaatgtgcttcagtattacattttttgccttcaacgccttgattgttctatttttgctaataataaatctatttcatcggactaaaagtccattagttgtaagcggatttagctcagttgggagagcgccagactgaagaaaaacttcggtcaagtcatctggaggtcctgtgttcgatccacagaattcgcattcctttttgctagcattcttttttttttcatttctaggcctgtttctccgcgctgattggtcgcccgggtgatgcagttgcggccggccctggccaatcagatccctttaaaaatgggcccggtgcgcttctaccccttcacgccttttacgcctttttcgaatcttgtatttattgtaattattatacattggtcatatcaaattcacatcagacttcaatttttcaattcactttctgaataagagcccttcccttcatacaagtagagatattatactgtcatagctctttcaattggtcttattagattgtctccatctttcccattgacgttgttactccctctcttttttcgtttttaactgatttctcatatattcccaaacaggcatatatactcgacgtcaagaaagaaaagaaaagaaaaccctcataaaaaatataatcgagaagtttttttcctcatcgcgaaccattagtataacagattgatcgttcagctctcataactatcgcaagaacagtaacaaaataaataaaaaaaacacgcacatataata

SEQ ID NO: 343 - DNA, 1000 bp, Saccharomyces cerevisiae
attggattatagcctcataaagacaggatccgtggcctttattttgataaggtggaaagatcagaaattgagatattttggctctgaattttttatctatatcctcatcgaaagattttgctccaaggtagtgccaatacttgtaagtagtgacgaaaccaatcaattcttttgttttcttgttcaacaaccaatagatttgccaactcgggtcagtctcatctatatagttagcggcttcgataaaaagtaatgaaaagatttgaacacgacgatgcattctcctggcaaaatcgtcaaccaaactcgatttatatacaacaaattcttccccattcaacgaatactctgatactttttcaaaaacatcagataaattatgtgtttttcgttcttctgcaaagcaatctacccatttagcttcatccctaacaattacatcatcctttggtagaaatgagagtaattttttttccacgtctacaatattgtcgtctcctaattttgctgaatacttgacgttaacatacggcttgaatgttactgaatcaaatgctaggtggatgatgagatccttatagccgtagatcttttcggagtcaccgtaaattggatacgtgaataatggtgaaaactgaacagcgttttctccaactatagaaactcttaaggcttcgttggcgcttgaagtccacgtttcaggcttgaaatcattggcagacatattcttgattctcactatagttatagcttaagcataattttgctgaaaacaattccagaaagatctattcctaacttcaagtagaaatacatagaaatctaataaattcgttattcgaagacaatatatttatcacttataacggtgtgctatttcaagaacttaatccatcaattctgggatatattataaccttttgaggcgatgcagtagaccaaagactttaccacgacttgaaaatgcttggcgtaacagccaacttcgaaactcactaac

SEQ ID NO: 344 - DNA, 1000 bp, Saccharomyces cerevisiae
tcccctcttgctgccttcctaaaccctaaacaacctgtagatagcgaaatcttcactttctggggtaagttcaaatagtacagcattgtatcattatacgtaagtcccttattcttatgaaagttcttgtcctccacaacgcttgaaaatgtcaaatgcgtgttatttttagtaaacttgccatgtagaatgtacttaactacttcctctttgggcttgtaaacctcactactaccatttgactttgtcaaaactgagtcagaggacgaaggatacgagatattcgtgatatcctcctgatttgaaatatccttaaatgaaaaaggaactcctctattcgtgccggtagaattccatcttctgataggcctgacaaactgcgtccatcggcagcctttccaaacaggttgtaacagcatcacacgtaactataacagttcacactgtcactttttcttttcagaagaaccactgctttccacctgatttactctcattttgtcttccctctttcccaattcatcgttattatgccaaacagtcacgaagtacgaaacaaacactctccgctgctatagaaagttccaatcttaggctgaataatggaatactagtagctcagtgattatcatcataattgaagctatcattaaaaagcatgcagccatattatgcaggaattatatgatcacacgtagctgtagtggctttcgaaagcagcattcttgcttccactcagttcgtatgtaatgacagttcagtgacccacaaacaacactgaaaaaagcgaccttcatatgcggaagagggcaggcgtaacctccaagggaaaacgacatagatttcgcaagtgagtgccattgtgtcgtgttagtagtgtgggcaggcccgtaacgtgtttattgataggagttaagcccaagactacagagttctttgcttcatctttcaattttctttttattttccgaaacccccactccatcacattctagtacat

SEQ ID NO: 345 - DNA, 1000 bp, Saccharomyces cerevisiae
cgacatattcgaggttgactttcctgaaggatttcaatttggcactatggctttgtatgatgttttacatggtgagaggcacgtaaatcgttacagcgaaggcatacggtcggagaatgacgaagcagaggttgccctaaggcagcgtagaaatttactactcttttggcgaaaccactcttctacaccaaaaccttcactacgccgagccgccactatagtatatgaggatcatgtatcatcccgttattttgaggatataagttctatattaggaagcactgcaatgagaactaaaagactatctccctataatgcggtagcattggacaagcctattcaagatattagttacgatcccgcagtacaaactttatatgtgctaatggcagatcaaacaattcacaaattcggcaaggacaggttgccttgccaggacgaatacgaaccaagatggaattctggctatttggtttcaagaaggtcaatagttaaatctgacctcatctgtgaggttgggttatggaaccttagcgataactgcaagaacacagtataattccctcatttccaataacattgtcgctgataaaatcgtgattctcgatcaatgtgctacgcgtcgtgcagcgtgacaaggggctaaaaaaagatacaagaattcttgttgtttccaatttgcttcgcctcagaaaaaaaaataaacagattatacaatttttgtttgatttgtattgggtactacatgttttagtagttgatacaaatacttctttatcctaatcgtatatatttattttaccagcaggaattcgtctttaatatcgtttcgaccatcgatcattcctctgagtattgcaaaaacatttttggaacaacccaaacttaaagttacaaaactcaaaaaaggaacaaaattaataaaacaaaagaatcgctgttagaggtttattgttgcactaatagaaaatcatagaactttaaaaattatactagaaag

SEQ ID NO: 346 - DNA, 1000 bp, Saccharomyces cerevisiae
tgataaaagtaagctagccccattatggagcagaaaactttggaagaaagtattttgtactccagcattctgggtacttgttgtttttgatacatgttcgtggaataacatgactgcgtatagtggttcatatactttgtggttaaagtctaatacaaagtactccattgcccaagtgaacaacctgagtgttatacccgcatgtttaggatttgcgtatgtgattttttgtgcctttggtgccgatttatttagatgtaagtggatattcatggtttttgctgctataatgaataccgtttcttgtgccttacttatcaagtgggatattccttcgaaagctaaatggtacgctttcttcaccacgtatttcagtgtggccgcatcgccttgtctatggtcgtttattaatgacttcttaaggtttgatcctcaggtgaaggctattacatggatcgccatttattccttctctcaatccacttacgcctggattcctaccttggcgtggcctaccgtggagtcaccacgttttaagactggttacaccgtgagcttaatttttggtgctatttacggtttatggacgtttgttgtactttttttttacaagagaaacgaaaagaaacatgctctaggtaatggtatcatcttgtatgatagtaataagggtgaagagcttccagaatttgtaaagaaaaatatggaggaaagagatggttactactatttaaagcggtcctcgtagtccaatttacgtgaagtagataggtatattacgctttagacaccatacctcaaataaatatattcatgtatataatttaatcatcttctatctataattaatctcgatgttgataaaggtcaccttatacgttctatgagtgaaatcgagtgaaaaagtgaaatttaagaaagggctcgaaggatgtactgtgtaataattacacctggccacattcagtttggcaaaagcgaacgaggtacagtgtaagag

SEQ ID NO: 347 - DNA, 1000 bp, Saccharomyces cerevisiae
tttacgcagggcaatttcggggacaaagggggctgaaggaatacaattccgatccaaggcaacaagtaggtcagaaccctttattaacctgcgcttgttagtggcttcctttgtactctgtccgtaatccagcatagcgctgaattgctgaaagatatgggtagcggtcagatgagaagggcaatcgtcaggacttctgttgaaaagcggactaaacataggcattatcattcttagagttttacgagcaaatagaatcgagtgacttccgtcgttgctaacaggcgcagtaataataaccgcggacgaaagccacgcaggcaaagaatgctttcgctgaaatatcggagtcttgctattgttcagggctttgccggtgcgtaaataataggctgaagcgaatttgatttcccgcacaaaaaatttttgctcgagtaagtcatacatatatcttgcatgcgtaaaaaaaattgcaattgctgaagattgaacgaccgcccaccggtattttcatctcttctagatcaagactaactgctcgttcagtacaagtattttacgatagtccatattactcttcaattaatattttttttttatattctggcccgtttttgacacaattttttccttctctttttctccctataaactatgcagaagtagcgataatcacgatcttgttaatgattcacatgtgcgcaagtcgtattgtctgtctagatagtgagatgccttctaaataacaggagagaggcaagatagcataacggcgcaatgaaggtaatttctgccagttttctttgcattgacgactgaaagggcccttgtaagagccgctcgacagggcgacgccacagtagagtcgctaacaccgaaatatgcatattgaaaaacatcaaagtataaaagaacaaagagggtggcatctgcagatcaaaaaaaacaataaccaccaaacaagacactaaaaaaggtcgtaaaaaggtcaaaagttaga

SEQ ID NO: 348 - DNA, 1000 bp, Saccharomyces cerevisiae
ctatttacaacttactcaaatatgtttccacacccgtgatttcaaatatgcatgttacctaatttcacaagctagaaaaaatttggatacttcaaataacaaacagtggatgatgtattacatgacatctttaaagttggcgtcaagaatgcatgaaagcgaacggtttagtaggattttaaaagactggaattgtaatcatagggcaagcctgattactccaggttgcattagacaaatcaaaggctttatgaaatattttgagaaaaggcctgcttacatttcaactgctgcttccattgataacaaggagataaaggatcgcattgacgagttagtacttagatatgtggactataaataccaggggcttgagaatatgagaaagttaacacttttcttaaaagaatggtttgatgaagagatttcactattaaagttggagcaaaatgaaaggaaaatgaagctttttgaagagaataaaaaggaggaggagtaatcttttcagttatttaccttcctttctctcacgtgtaaatatttgtgtgtcatacacaccgctaaaaacctttgcatcaacttataccctacatttctatagacgctatttggaaacaagatgtaaccctttttttcttttagttttgagatttgtactcgtaaagagtacgtttatttatttattcaaattttattcttcataccatgtaaatataagcgcatataatcactacgatcttagtacagctagaattgctgacgcttacaattgctttattgtttgattatatgcacgtatacatatagtgtcagcaaaaaaaaaaaaaggcagtacttgattggctacgccgcgcatcgtccgagaaatccggcctggtaggggcaggtttgaaaaggcggatagaaataaaagatgatattatttattcatcccatgaatagtagaactcgatataagattctaaaccaacaagtacagaaagcaaaacaataataaata

SEQ ID NO: 349 - DNA, 1000 bp, Saccharomyces cerevisiae
atttttttaacgaataaggatagaaacaaattatcttgtccttcatttactgtgttaactttgccatttatgcttgaaaactggtgtaataaaacttttgctaggcttctaatcaaatgttgttgcgcctccgttggtggatccttaatttcaatacttccttgcccctctctcattaattcttggccagttataatcgaagtctttaaacggtcttttgggaaactttccaacttcctcttgaccactgcttttaacagattcaaaaattctcccagctttttgttgctgttttgtttcgagtcagaaccagaatgtagagaagaaatttgctcatcctctctaaacatacatttgataaccctcagagatgatcctcgcacttgtaggtcaactatgtagctcatatccttattttatgtcttcagtttgagatcagaatatttttatgaaaatgttgtcactctcttttaaccgcctcgcatttcgtagatttgccgcccaccttattgtcaacggcaaatctaaggatatatatacatatatatatatttttgagaaagattatattttcgccaacgatgaaaaagagaaaagtacagtactatgtattatgtgtttttcaactcaagagaggggcaaacatataactggtgctatatatgattaaggctgcgctcaaatatacttcttacttaattgactgaacaatacgttgataagatgaaggaagagtctcagatattggtttcacaaaaaattcagagaatggagtcatttcggttacgggcaatctttcggtgattggtacggagtatcgcgatctttacacgttccactagtcaatccaatccaatttattcatttgtccgtaaatattctgccggccttctccccatattacaaaataaaaaaataaaacctgagtaatggaatagttggaaaagcaaggcaaatttccatcagaaagcaagcctatccattcagctaagcttatgag

SEQ ID NO: 350 - DNA, 1000 bp, Saccharomyces cerevisiae
aaagtgaccgtaaggattctgcataatgttattggaaactcaactactcgctgccgaacggttcctactccttgtattctatggtttctttacgagacagccaaatctctattttttgtcatgttcagtccttttttactcaaaaattccaaaccgtgaaggatgatgcatgttgacaataaatgatagccgtcatcacatacagtgtgcaatatctagatacttctaaccatttcttcctgtcgtggggagttcataccattttgacagatgacaaacagtagtgaaaaacaatgggaaagaatccagcaattagaaaaggagcacgtggaggtatatagagagttgttgatcacgttggacaggttgtacttgattagaaaacacaatcatgcggtaatattaagccatactcaacagcgcctcttggaaattagacaccaacttcaaattaatcttgaaaagactgctcttcttattagactgttggagaaaccggacaataccaatgtattattcaccaagctacaaaacctcttagaagaaagcaattctctggactatgagctcttgcaatcgttaggtgctcaatcttcattgcacaaacagttgattgaatcaagagcagaacgcgacgaattgatgtcaaaactgattgagttatcgtcgaagtttcccaaaccaactataccgccagacgacagtgatactgctggaaaacaggttgaggtagaaaaggaaaatgaaacgatacaagaattgatgattgctttacagatacactccggatatacaaacatatcctacacaatttgatttttatcttctaatgctatttatatattcaaataattttaatactgacaacgctaataataatagttacttaattaaggtttgaatcttcgagaaaaaaaaaaggtaggaaaattaaggaactactcacaaattcagagagagagaagggataaaaaaatatctgccaatggaggtaacttca

SEQ ID NO: 351 - DNA, 1000 bp, Saccharomyces cerevisiae
gcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataagcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgccagcattgaaatgatcgaagttcaatgatgaaacggtaattcttctgtcatttactcatctcatctcatcaagttatataattctatacggatgtaatttttcacttttcgtcttgacgtccaccctataatttcaattattgaaccctcacaaatgatgcactgcaatgtacacaccctcatatagtttctcagggcttgatcagggttccgtagatgggaatttgagaagtataagggagataacggtaatgttatattgagaaaatgaaagatgaactcagtattgacaggatctaaaaccaaaatatagcgggcctatacaggaagtagtatttgtaaaagtaaacc

SEQ ID NO: 352 - DNA, 1000 bp, Saccharomyces cerevisiae
tgctgggcgctctggcccacgttttctgtaatgtttcgtacacgttttgcaacttctttccttttactaatcagttcttgtaatttgactgactgtagcatacccatactgacttcatctgcacgaattaaagaatcaatctcttgtcccattaggcctatccgcacgtccaagacatctagttcttcggtaacctgctgaatcttcattcgttcctcagcggtgtgttttagattttgtagtgctacggatatctggccattacactcattaacaaaccgagatagaatggccagatattctctttcgaattcgggaaacgttttgccctgcttgacctctctctcgtactgaattttatgcttggtaagatgcatctgcgggcattttcccaggctctgcttggtgccctgaaacaggtcgtaggggcactcgccaacaaggtatgacttgcagatcttgggatcgtgtagtccgaggtctcttttttgatgcgaatacctgttgtggcggaaactgaagtccctgcccatcagctgttcgacgagtttgcgttgttctgcggcaggcgttgacatagttgacattctgacggtagttggcagctttctgctgggagtgtagagccttttgtagtataactttttgttcttttctttcttctctaatgcctgaggcttcggcggttattcgggtaatacattaaggaagttgccatgatgtggaagaatacgactagtcagttagcgatggccagctcctttacctaaatcatgtggcctatcttcagatagcatactaccaccaaccatcaatacctcaatggctttcaacaagtacccttcgtcgggttttcagcttttttcctactttgctggatgctttgtgaagatcaggaagaaattttatcggaaaaacctcactaggagaaactatataaaagaagggtcagactgaaaatgacgccgtaataaactcgtggtagtagataaagcaaaca

SEQ ID NO: 353 - DNA, 1000 bp, Saccharomyces cerevisiae
tgagacggcttatttgaggtaatagctcgagtaaatgtactcttccatcgcaaactgagcaaaaagaaagtgtgcatagcctttgtcatacttctcctttattataccatgatattcagaacagtcatactgtctactcattttacggctataaaaggtaactttcatttagattatggaaagcactaattatcgctgtatcaaatggttgtagagagcgcaattatgaaaaagagttaccacgtttcttttgtttcgataaaatgtccagttgaaaacctgttttactaacgatttaaaaattgtatttcattacaatattttttttgtacagccggtaaaggtcgtatcggtaagcacagaaagcaccccggtggtagaggtatggccggtggtcaacatcaccacagaattaacatggataaataccatccaggttatttcggtaaggttggtatgagatacttccacaagcaacaagctcatttctggaagccagtcttgaacttggacaaattgtggacattgatcccagaagacaagagagaccaatacttgaaatctgcttctaaggaaactgctccagttattgacactttggcagccggttacggtaagatcttgggtaagggtagaattccaaatgttccagttatcgtcaaagctagattcgtctccaagttggctgaagaaaaaatcagagctgctggtggtgttgttgaattgatcgcttaagcgcatcaacaaaaactctatgtattttccaataaattatatatcttcagtttaatctaattcaacatctacttctgtattatttctatcacccattttcaccgttttttcgtcttgtctattttgaagttaccagtggcagatcccaacgcttttatcgcttttttaaaagattttcaaaatccatatataaacatagggtccaaaaagaaaacaaataacaaaacaagaaaacctattcgaggtaaagaccaggaaaaacaaa

SEQ ID NO: 354 - DNA, 1000 bp, Saccharomyces cerevisiae
gacgatgaatgcatcgtctacggcgtagcaagaacggaagctggtctgcagtctttgcaaagagaatacggtgcagacaaatttgtctatcgtgtcctcgacatcacggacaggtctcgaatggaagcgttggtggaggaaatccggcaaaagcatggaaaactggacggtattgtcgcaaatgcggggatgctagaaccggtgaagtccatctcccagtccaactccgaacacgacatcaagcagtgggaacggctgttcgatgtgaactttttcagcattgtctctttggtggcactgtgtttacccctcttgaagagctcgccatttgtaggcaacattgtcttcgtcagctctggagccagtgtgaaaccatataacggatggtcggcgtacggctgctcgaaagccgcattaaaccactttgccatggacattgccagtgaagagcccagtgataaagtgcgtgccgtgtgtattgcaccgggcgtcgttgacacgcagatgcagaaagatattagggaaacattgggtcctcagggcatgacacccaaggctctcgagaggtttactcaattgtacaagacttcgtcactgctggacccaaaggtgcctgcggcggtactagcgcaactcgtcctgaaaggtattcccgactctttgaacggtcaatatctccgctacaacgatgagcgactggggccggtgcagggctagtactaaactatattatgtaaaagggtatagttatagtttttagctactaaacttttattgggtttgcgatgagcgacagttttgtgcggccatttctgtgccaagaaccggattgaatgtatcaccgaaggaattccgcggtgttttcaaagaaatgaagagaagacagtatgaacattaacttttgcatatatatacgtaaacgaaaaagatcaagtgcaatggaagaatattgtacctaaaaaaaagggtctaactacagcgtgtaacaggttaaaaaaac

SEQ ID NO: 355 - DNA, 1000 bp, Saccharomyces cerevisiae
gcaaacttgatgtgtgtggtgtccttaacacctaaactcttagcccacgcttggttagcgaacgggttgtcaacagtaacaacgatcacttggtcaacttccttttccttaactaattcatccaagtagttgatgtaacctggaatatggctgacagtacaggttggggagaaagcagctggagcaccggtaatgataaccttcttgttttcagaaattaatttggaccattcaactgtttgtggcatcttacaagattcactgtcagcatcactttggctgatagcaatgtattggaatttgtagtcgccagctgggaatttcttgttaactaagtcagacatgttttgttgtggttattggtagtacttgtgttgttctggtttgttgaaatttcgttataaagaaacggtatatgcacaattggcaagggagaggaaattgtgctcctttatataatgtttcgtttatgcttttcccttacatctcgtccttaattttccacccctttatttttcatttaacctctcaacaatatgtgaataccgtccggaaggggtgtggaaaaagaaaaagaatgatacagaagaaaatcaaaagatgatattcaacttcatcaccaaatactgacctttttggccagagctccccgtataattacaaatcagaaaaaatccgcgctcactaccttaacggaaggaaatattccacatgtcggattaatttttctctggtcccatgaccatgtgccgaaatcttttcagtgacgtcaggaccggtttttccgagagccccacaggggacgccgatgatttagggttcttttcttgattactaatagacaacataagcgcaatagatcgaggccaaggtggtggtttataaattgtattaccttaaaggctcattattagcttgaacacgaatatccaaagaacacgaacaacttcaggacgtggatagacaagtgtaaagtcactcacacgcacgctcatatcag

SEQ ID NO: 356 - DNA, 1000 bp, Saccharomyces cerevisiae
gcaagtgacatgaacactgtaatacatcacattggtaaacaaagcttgaatcgtgaacctttctctaaaaatttcgataatatgcataaaggttcttgaagctccccttgttcaagtggtttatttttctatagatatttacactccgcaagtgcaaaaaaaaagcattatcgctaacgatcaagaggaactgagaccttattagttgtctttgttggcgtaacataaatttcttaggaaaagagaaaattatctcgaaggcaaaaataaaccaagcctcgagtttaatggttttctaaaaaacactttaaaaacagatcgccataaaaggagaagctccgtaggagaccgttttcgaaacctatgtagaaataaagggaaagctccaacggtttggataaatctttagaagcatagagtttatacaacattcagtacgaaatgtactctcgaaacgttctcttttcacggtgcttagtagcagaaaaaagtgtcggaaattacctattttgtcaccactcgaggataggcttgaaagagagttttaaccccaacttttctattttgcacttgtttggctatggtttaaaacattctgtttggaccaacagcccaagcggcttatcccttttctttttttcccttataatcgggaatttccttactaggaaggcaccgatactagaactccgaatgaaaaagacatgccagtaataaaactattttgatgttatgcggaatatactattcttggattattcactgttaactaaaagttggagaaatcactctgcactgtcaatcattgaaaaaaagaacatataaaagggcacaaaattgagtcttttttaatgagttcttgctgaggaaagtttagttaatatatcatttacgtaaaatatgcatattcttgtattgtgctttttttattcattttaagcaggaacaatttacaagtattgcaacgctaatcaaatcaaaataacagctgaaaattaat

SEQ ID NO: 357 - DNA, 1000 bp, Saccharomyces cerevisiae
tttttcgttggtaacttgactcttttatgaaaagaaaacattaagttgaaggtgcacgcttgaggcgctcctttttcatggtgcttagcagcagatgaaagtgtcagaagttacctattttgtcaccatttgagaataagcttgaaagaaagttgtaaccccaacttttctatcttgcacttgtttggaccaacagccaaacggcttatcccttttcttttcccttataatcgggaatttccttactaggaaggcaccgatactataactccgaatgaaaaagacatgccagtaataaaaataattgatgttatgcggaatatactattcttggattattcactgttaactaaaagttggagaaatcactctgcactgtcaatcattgaaaaaaagaacatataaaagggcacaaaatcgagtcttttttaatgagttcttgctgaggaaaatttagttaatatatcatttacataaaacatgcatattattgtgttgtactttctttattcattttaagcaggaataattacaagtattgcaacgctaatcaaatcgaaataacagctgaaaattaatatgtcgaagggaaaggttttgctggttctttatgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactata

SEQ ID NO: 358 - DNA, 1000 bp, Saccharomyces cerevisiae; identical to SEQ ID NO: 163

SEQ ID NO: 359 - DNA, 1000 bp, Saccharomyces cerevisiae
agaacatccaaattcggaactactaagaagatatgggtatgttgaatgggacggttcgaagtatgattttggagaagtgttacttgaaaatattgtcgaggcgttaaaagagacttttgagacgaatactgaatttttggacaggtgtattgatatcttacgcaataacgccaatattcaagaattcttagaaggtgaagaaatagtactagattcatatgattgttataataatggtgaattgttgcctcaactaatacttttggtccaaatcttgacaattctttgccaaattccaggtttatgcaaactggacataaaagcaatggaaaggcaagtggagagaattgtaaagaagtgtttacaattgatagaaggtgcccgcgccactacaaactgtagtgccacatggaaacgttgtattatgaagcgtctagccgattaccccataaaaaagtgcgtttctatcgaaaaaccttcgaaaggaaactcattaacaagggaagaactaagagatgttatggctcggagagttttgaaaagcgaaatagattcgctgcaagtttgtgaagaaaccatcgacaagaattacaaggttattcctgatgaaaagctgctaactaatattttaaagagaaagttgacagaggaagaaaaaagctctgtcaaacgtccttgcgtgaagaagtgagcggttgttctaaccactatttaaagccgcaattagtaatgcaaaaagttggccggaattagccgcgcaagttggtggggtcccttaatccgaaaaaggacggctttaacaaatataaactccgaaaatccccacagtgacagaattggagaaacaaccagttttgatatcgccatacatataaagagatgtagaaagcattcttcactgtaatgtccaaatcgtacatttgaatttcttgtaggtttatttaaaaggtaagttaaataaatataatagtacttacaaataaatttggaaccctagaag

SEQ ID NO: 360 - DNA, 1000 bp, Saccharomyces cerevisiae
gaaaacaccggcaacaagctattaaggagggtgaaaagcttgaaaactagtaaaaagcactgatcaatgcttctttcttgcgttctttttgttgcgcccatatattattttatttattacattcatatagcaatatttaccttattttattggttacttttctatacgcaaaatcactacactatgttatgttaaggtctccgatacgggaatataccaatcaatacttatcacttcggattttttatgggtcttatccccactgttccattttcttgtttaaggcatcccggaggataaactaaaaaggtggcccatcccacccgaaatgaaagtaatcatctgctagcaaaaagtaaagaaatgagagcatgctgtgatgtactggtggacgaaattgtgacccatacccaccgaagaaacatccgcatgacgtgttactgttacttcccggattaagggatgcattctaactctgtgcgcccttttctctgcagttgatccgcattccccgtggctgtgcacattaggggacagtaagtaattcactttctgatcccgcactcatagcgatggaataatataccggatttcacaccttgttattgagtgaagtactgcttggtgaaatgatatctttatgttcaatattaatggtcgtgtggatgaatatatgggcatgggttaattagttttaggggcacggagtaaacaagaaaggagggccagaatcattagtagagtacctcaagtttggtttctttttgatttcacgtataaaagagtctctctcttttcttttcatgctagtcgaacggttctccctctaagaataagaaactatcaaaagaaagagaaaagtcgattgaataatttttctatatataatatacgcaaacaagattcgctttcactttgcaattttacttcatagctttgttaaaaccagcaaaaaatattatttttctagaaaaaagaatatattagaggtaaagaaaga

SEQ ID NO: 361 - DNA, 1000 bp, Saccharomyces cerevisiae
acagaaatgcctactattatctttcaagagtgggctgggcaatgcttctaatcgggcttttctttttgttaatcacgttagtttcggttattgccagtttaatcagatacaatagacgtaccgccgctctggcaactgcaatgagctggatcacgcttttcttcataaccctatccgcttgtctgtacacaggatgttacgctaaggcagtaaaggcgtttcaccatgagaatcgtgatgctagactaggtcccaagaattttgggcttatttggaccacagtatttttgttaattgtaaacgccatttgctgtactatcatggtggctactcataaaagaaacgagtacatctatgaccgcagtttcgcttctaccaagacagtggactcacaaactccaactccagttccaacaaatggaggaataccttcctcggtgcctgtaactgaggtccaacaatctcaatcccaccagaatcataggttctttaagaaattgagaacgaaaaagagaactgtgactagcgcaggcgatgaaccagaccgggttcaagaggaacgcgtctatactgaacagaatgttcctgttgtatcatagggtgcaaaggaggcttttttttcccttattattaaagctaggattacaaataataacaaacctaattgcagcgattagccttctcctattctctgttgataccaattttatttattactaatattttgcaccgatattccactaatcttttatgtttccctaaatataatatctttaattctcaacctctaataatactaatactatacgtcaaacaatgtaatgataccatctaataaaaagaaatcgtattttaacttccttttaatgtatcatacacatcttactaactctttttcttttcttttcactatttcgacagcaatgaattagacacaaaccaagagtcttctgctacacagcacggcttcggctaccatattgacaaatcttatgacagg

SEQ ID NO: 362 - DNA, 1000 bp, Saccharomyces cerevisiae
ttcgtgataaaattattgtcagaatagtgacttcattattctttataactaaccattaggatcatataagtaatcagatgcagttcgtcattaatatgtcaggatggataaccataggtaagcacgtgattatggaaggacagtaaagttaccgatctacttttttgaatgatcaacttggtgttttcatctataaggatatgggtcgttacattgaaactatagtaaaagatctcgttattggtatatcggtcataatgaagatgaaatagtcggtatgtatttttatacccccccctatatggtaaaaaggttaagattcatatttaaatcttcattaataccacctctaatttctaattaccaacatttttaactccacttttattatatgctatatacaacattatgtaaaaggagtataccaaaaattctccttcataatataggaattcacaaaatggaaccgatatctccgcataatgctattatcatttcttactcgttttatacattgtcattcattatcttattgcatttgcaatccttgttttccggcttctgtgaaatttgacgactgattctcaattttatgtcatctttttacacttatatatgacaatatactagtagtatgaagactaatcaacggaggttatttgatttctattctaacttatttgaacatatataatttgtaaattttatgcagattagacttgggagttatcacaacattttgtcagtgtttagcctctttcacctttgcctttttcagccttttttgtgtaaattgatggtgtagtttgtttctgaaagggctctttttatttttttcgcttccgccgttcgttattggataatccccgaaatatgctagagtggctgatacattatagaacataaaagtgagctgcaatgagcactcaagcacgttattgacaaggataacggaaaggtacactaatacttatactgattaataagggttagcctttta

SEQ ID NO: 363 - DNA, 1000 bp, Saccharomyces cerevisiae
accttgggatatcgttggaaatcctaaccatcggcataatttttgaagacttgaataactccataatattaagcgtgctggtgcttttgggctcactactgtttagcggactatttatcaatactaagaatattacaaacgtggccttcaagtacctgaaaaacttctctgtgttttactacgcctacgaatctttattgatcaatgaggtcaaaacattgatgctgaaagagagaaagtacggcttaaatattgaagttccaggcgctactatcttgagcacatttggatttgttgtccaaaaccttgtatttgacatcaagatcctggctctgtttaatgtggtgtttttaataatggggtatctagcccttaagtggatagttgtggaacaaaagtagataggcgtcgtatatagtctcttcttttacataagaaataataatttttggccccgcaactttccttattttcgagagggtccactgcccgttgatccggagctccgtggaataggcgagcggctgagtggttctccaagctacggtttttacgtgtagccccatgtgagcaagccaaacaagggcccttaaaggcgtgactacaaaaaggggcgggttggaaggtcatctgcagcgagatacgaaaagattttttgccagatttgcggttgggcggctatttcggtattgttggggtaacaaacgttggggaagactgcattttcttacagctttttttcgttatcgcgggttgggcggctatggcgccttctcctctgtactccaacctgtcagagacaccaagctgtatataaagcaccttggttggatcgtatttccctgagatcttgctataggttcattttatatatcgtccaatagcaataacaatacaacagaaactactagcatctgtttataagaaaaaggcaaatagtcgacagctaacacagatataactaaacaaccacaaaacaactcatatacaaacaaataat

SEQ ID NO: 364 - DNA, 1000 bp, Saccharomyces cerevisiae
aatctatggaagaagaatattaaagaggccaatggtgaaattctatccgtgtctcaattcactttgatggcaaaaaccaagaagggaactaaacccgatttccatttggcccaaaagggtcatatagctaaagaactttatgaagaattcttaaaattactaagaagtgatttgggtgaggaaaaagtaaaggatggtgaattcggcgcaatgatgagttgctctttaactaatgaagggcccgttacaatcattcttgacagtgaccaataagattgaccttatagatatatacgagaagaaaataaaaagcaaacattatttgcaatctttctttcgcaagataaagtaccaaaatctttccatgttatgttctcagtgaagttgagtagagcggagaggagccctccccaaaaaaatgaatacaaaatatctgtgatggatttttgaattcacgcttccttcaataaccttcgccaagaaagtctagaattgttttatattctttacataaaagtaagtaaatcaactttaaaaaactttaagggcgaaaatgaaaaaaaaaaaatgtaaaagtgaaaaaagggacggcgaagcgatgccctgccagtcttactaatccagagggctaaaagcatgtttacagtgtatttccagtcataggagagtattgacctggcatggaaaaagaaacgcacaatgagaaaggggatatatacccttaaattgacgatagttaaggagattttgaggtttgtgttactaataaaccagtaagcatactcgttgatgactttaacgtatatttggtttccaagggatattgaaaccgtatcttaagggatgacgatggttggttaacattccctaaaagacaacgtataaaaaggttcaacaaagcgtccgttaccattatgctttgatgttctcagtacgaaagtttacggttttttttttcaattgaggaacataaaccaaatagatatattatatcaacgtt

SEQ ID NO: 365 - DNA, 1000 bp, Saccharomyces cerevisiae
ctttctcacaccttccttcttctacttccggagtatagtctctagcttatccttgatggctctttttatgcaggcagaataattacagtgacgtatttgtggcttctttggcacaacgttttgttccacgatcacctcatatcaccgttaagttcttcatcgtccaattccggagttccccgtcagccgtgcgaccatgtggtatttcacccgaataattaagggaaaacagaaggagaattacgtatcttaaaggagctagactctttgcctcattgaggctttctatacatcgggtccccatgtatggtccgttccatagtcgaagcatccttaatttcctgtgacattacagtagtttcgccgtagagcctttcacgggaagaatatgttcagtggttccaggtatgggtttgaggatgttcttgtaaggtgtgtagatcccatcttttttagggatcacaaagggaaaataactacacagcatgtggtggtacagatgaggtcaatggcagttttgccttagttgtaagtaattaaccaatccttgtcgtgcttctcatgaatgtgtatgaatttatgttcatcagaatatccctctttaaccacagttcttgcgtaaagcatagtctggcttcctttagaaaaaggaaatgtggtaattctaggaccacgttttgggcttcgtcatttcttttcactcctccacttttatgacatttgatcgcaagttcctccatacatcatgcctagtaatcaaaacaaataacgcacaagggagtaaagggaaatggttagaaaagaccgaaatcctttttttggtctccgttacgtgcttgttaatcaggctcccttgaagcagtcaatatttcttggactataaaagcacattactatttcatcaaaaaaaggatacatacctaccctcaactcttaatatctactagcagcagagccaaacactaccgcataaaagctaagtacgaataacaattaagaa

SEQ ID NO: 366 - DNA, 1000 bp, Saccharomyces cerevisiae
ccggtggtgcttatactgtttctactgcagctgccgctactgttagatctaccatcagaagattaagagaaatggttgaagcttaaacttctttcattcattttctcttggctttcactaggtatatctattccataacgactatgttttgtatttgttaatttacataaaaccatatcagtacatcaacgaactgtaaaaaagaaactttagcataattattgcggatatttaaactcacttgcaggtaagagcaaaaggcgattgatttccagtccgcctcttgtcacgtgatttagtaagaaattttgacagcaccctcggtttaatggaaaagaggggcgtttttcgatgaacccgaggggagactagagaatcatctcggttgaatggagcattatttttttagtagcgcccgcccggagaaatggacgttggcgaatgagccatgaattattaaccgcccatgtctaccagataccacatcgtatgacagtaccagcctagtcccggtaaaccgcaaacggaccttaattgtgacgaagggcccaaatttgatgggtcggtgttaatgattagtcctcattgtcataataaagtgtgatgatggaggcaatgatgatatacggtagtactactgctcgaggtgctatcttttaaccaatcctttgagattcttgtcgccacggagttactaccttttacaaaccgtaatgtcacattttgcatatatcttatgtataaatatatagttcacttactacttgttctcgttttgttaactttcttgttgtagttcttcttgttcttggcgtttccccctttgttttctatctgcttcataagtaaagtgcaaagcattttggaagatattatcaattgagtcattgaaagaaacttggcatcttccctattactaaaactaagaatacttgattcaagaaagaagtttatattagttttagccgtaagataacataacaaagaagaagaaagaaaa

SEQ ID NO: 367 - DNA, 1000 bp, Saccharomyces cerevisiae
aatggcaaactgagcacaacaataccagtccggatcaactggcaccatctctcccgtagtctcatctaatttttcttccggatgaggttccagatataccgcaacacctttattatggtttccctgagggaataatagaatgtcccattcgaaatcaccaattctaaacctgggcgaattgtatttcgggtttgttaactcgttccagtcaggaatgttccacgtgaagctatcttccagcaaagtctccacttcttcatcaaattgtgggagaatactcccaatgctcttatctatgggacttccgggaaacacagtaccgatacttcccaattcgtcttcagagctcattgtttgtttgaagagactaatcaaagaatcgttttctcaaaaaaattaatatcttaactgatagtttgatcaaaggggcaaaacgtaggggcaaacaaacggaaaaatcgtttctcaaattttctgatgccaagaactctaaccagtcttatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaaaggcagaggagagcatagaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacaca

SEQ ID NO: 368 - DNA, 1000 bp, Saccharomyces cerevisiae
accaaaaccgtcgagacaagtactattggatgataacactcttatgaagtacgacagttctggccgaaagctaactcctatagaatcgagaaattcgaggcgcagctcaaagcggagttcaagaatacaattcaacaataacggcatttataaagtaaagtccatggttgatgacatttacaaccacgaaactgcctctacgcctcatatcaagacagcactaaaatgggacaatgaggatccgaaaatgaagttcacttcacatccaatgagaaaaacaaaatccgcagggctatcacccagaacatcctccacttcatcttcttcaggacagagaaaagcgcatcaccaccaccatcaccacaaccacgtttcaaggacgaaaactaccgaaagcaccaaatcaggcaacagcaaaaaggacagttcctcatcctcaacaaacgaccatcaatttaaaaggtctgaaaagaagaaaaaaagtaaatttggctcgatcttcaaaaaagttttcggatgaaccggattaatacaagtaaaatcagcaaagatatagaagacaaaataagcgtgaaaacaatcataaaccactcacaacgggggttttcagctgttactcctccatacatacattttgataaagatataatgttatatttcttttcgtaattttgttttacttcggtttgctctatagatttcatcagccgcaccgaaaagggagatcaataaggtaccctttaaaagggataagaagcctacatcaccccaataaatggagtaatggccagcattggatgaagagaagaattacgggatactgggataacactgttaaaaatgcttcgcgacgtgagggtcttcttcatataaattgaactgccaaatctctttcacattatccaggatagtttggaatgtgtgttactgaaggatcagaatcaataaatacaatcaatacaaatatttagcgcataaaattcaaacaaagtttactgaa

SEQ ID NO: 369 - DNA, 1000 bp, Saccharomyces cerevisiae
gctatttgacaaaaatgttaacatgtgacattcacgtcagaaaagaggccaaagaaggaagagggtaccagcaaatacataaactttcctaaggaataggttaagttcttttattctgcatgtgtggatgcttaaggtcattttaacgaatgggtccattagccccgcgcctttttcaggtcagcgaacgcttataattccaagccatctcatgttatctcattattttaatgtgagcgaatatgctttttttttttcaattgctgctatgagattattgcttccattactaatggtagggttcaaggaggctgaaaaactggatggaaacggaaatgaaaaataagggggaggcgtaacggtggcaacgctgcatagtgaacaattcattacctatttatcatttttagttggaatttggccaccttatggcacatttaccatttgagggatctgaagatcaagtccgccttaagggtgcatatcatgcgtcatttgtctgcgttaaggtgcagacgcttcccttgaaaatcgccgaaagaagctaagccgaagtgacacgggccttttcctgcgtcaaaagaagccgatgatctaccagaaaaagatcattcaacagttaagggctacagtagttctcagcgaataccggctgatgtacagaagcgaattcctgttggggaatctcactgtacccttcaaatatgtaatgttagagtagcaaaagttcttggcttagcaattacatttaacgctgatgatcctcggtttatgagcagaaaatagggaaaaacgtgtacaaatgattctctcagaatgtgcaactagcatccccttttagaaatgccttgttgaaaattcccctaagacgttactcattagaatactataaaaattgggaggaaagctaaaaacacttttggtttctcttgttcctatcaatcatgctctagtatttgatttcgatcagttttcacatctaagaacccaatcagctatt

SEQ ID NO: 370 - DNA, 1000 bp, Saccharomyces cerevisiae
gaatggtgcggcgagcgcagtggcaatgccaccgctgaagaaagcgatagcgaagataatagcgaagacgatagcgaagtactagaaccaacaaaataccattatctggcacaaattgttgctaatgcgggaacaatcgcacccgacaccatcccacaagatataaggaaacaacaaaaagcgttatacaaggcctacaaaatcaaggagtatataccgtcgaagcgcgaccaagacaaattcgtttcccaactgctgttttattataagacgttcgacttggaacagcggaaagagattttctgcgattgcctacgggatcacgaacgagactttacgggggcagtcgaatcgctgcgtcaggacaaagagcttatcgaccgatggcaaacacttctgaaagcacccgcggacagtagtagtatagaggatatattgctgagcattgagcacaggtgttgtgtcagcccaatagtggtgacggaaccacgctactacgtcgtgggcattctggagaagaccgtggtctgggtgcggtggctagccgccgaggtcgggccatcaagccggtttaccccagtgggcgcggggaacgagccgataaatccggaataggaagggcagaccaggggagcaaagagtgattaagcttacgcacctggtatggacgtgatggaagtggggtggtgatagcaaccagaatacggtagggtctttacgcttagtgtacctatcggtattcaggctctttgccagtgattggggctgcgggatccgccatcatatctagtcacttttgtataagaatgaatgataagagcaggtgcaattttcggactttagatgtttcttgtgtttcattatttatagcacatttattttttccctctgagtgtgtgtctgcatgtatacattttagttgaattatagagagtaacgaaacacacacgcatacacgtatatacaaagacatatatacgtacggaaatagtgaataagg

SEQ ID NO: 371 - DNA, 1000 bp, Saccharomyces cerevisiae
aggagtcttatgtgacagcacttgcgttattgtcagccggagtatgtctttgtcgcattctgggctttttactttctgctcagaaggaagtacgaacaagaaaaaaaaatcaccaatgcttcccttttcagtattagtttcatatttgtttacgttcaaactcgtcgtttgcgcgataacctctaaaaaagtcaattacgtaactatatcaatcagagaatgcaaaaagcactatcataaaaatgtgtctaggggatgtgagacatgtcaattataagaagtgatggtgtcatagtatatatatcataaaagattatcaaagtttcaatcctttgtattttctagtttagcgccaacttttgacaaaacctaaactttagataatcatcattcttacaatttttatctggatggcaataatctcctatataaagcccagataaactgtaaaaagaatccatcactatttgaaaaaaagtcatctggcacgtttaattatcagagcagaaatgatgaagggtgttagcgccgtccactgatgtgcctggtagtcatgatttacgtataactaacacatcatgaggacggcggcgtcaccccaacgcaaaagagtgacttccctgcgctttgccaaaaccccatacatcgccatctggctcctggcagggcggttgatggacatcagccgcctcccttaattgctaaagcctccacaaggcacaattaagcaatatttcgggaaagtacaccagtcagtttgcgcttttatgactgggttctaaggtactagatgtgaagtagtggtgacagaatcagggagataagagggagcagggtggggtaatgatgtgcgataacaatcttgcttggctaatcacccccatatcttgtagtgagtatataaataggagcctcccttcctattgcaactccataaaatttttttttgtagccacttctgtaacaagataaataaaaccaactaatcgagatatcaaat

SEQ ID NO: 372 - DNA, 1000 bp, Saccharomyces cerevisiae
tggaatttggtaactgctcctcaccgatttatgtcatcttgctattatatggtaatataccaaatgtgaaggtatgcaattgatatttttagattttaccttttggcaaaaaatcagcacattagcaataagaaaccgttttatcgttttgttcattttaatgacttcacggaaattactagttattaatagtattttactcgtgaaagataataatccttccaatgatgattacactcaagatacccttaagattttttggcgtccatagaaaacttcactatttatagaaaatcctgagtgcttctttctttgtttatatactctgtcatccactattctacgtgaatattgtgcgaatattttgataattgtgaactccattgttgatcaaaggctataatgttgtgtatacagaatataatagaagttcctctcgaagatataagagtcctcataatggaatcggtatttctacataatatcactactttttttttgtccttccgctttatatgtttcgttatcctatcacattatcaaatgactttgtgccactgtgttttgacaaaattactgtaatataatcaatagtatttacatgtttgtaccagaagtacttgcatcgcatccagttctcatgcaatatagttgtataccatgtcgttgaaaggaaccagagtaaacacttctaccagtatttctttacggttcggatcaaaaccatcactcattcggtcattcttaccgtacgataaaccaaattacaaggaaaagtatccctaattagagatcactgcatccgtaatagttttttttctattttggacttttgtaaaaaagggattagggatacgttgctcataaaaaaattgacgaagattttagataatggcaaataaaaatgaaatagtatcaatataccgaaaaattaatcacactcaatgcgactgtgatagctgataagtggagctcagaaatattcagaagcgtaagaata

SEQ ID NO: 373 - DNA, 1000 bp, Saccharomyces cerevisiae
aatagtcttacaccaatgagccaaatagtgaatgcggtcctgaaccagaacgagactgttacgttcgcagcaagaggccatgtccttgaagatggtatagataataactcattgattccagcagacatgctggaggatattttccaagaagcatcgtttattcccattactaccaatgctacgtttaactccagtgaattgattcaagagtttcagatcaacgatcttcagctacggtgggcagcgcgcaaaaagctcagtcttgtggggacatttttaggattctttgatctatccttctacgagacgcaccagcaagaccgagttcgcatcgataccattcggggacagatcgatctgtaccataacgacatcaatttcttaaacttacccatgaagcaatggatcaactcttcatcgcacattctgcacgatgaggacacaggaaatacgcagatgaagcttcaatttgatctagaaaatgacgacatggaagtcgtcaatagcttggaactaacacgaaccctgaacgaaatactattccagggttttacagttattcactttaatgcgacgatagatgcgtcacttacgacggcattgggcccgtgggttctcaccgggttagccggagagggtgacactttggtcacgtgaacgtctatctatttatttttataactccgggatgtcattgccggtggtccgaaaatcggcaaataaggaaataagggaagaatatgcagtagtcaaatcatcagtgttctctttgatacctttcagggctaggaatagtgggggtggagtataatatcaaaaaccggacttaacattattggttcggttggaattggctataggcaaactagtctccggcatgatatataaatgacagcctgcaattgtatgttactacactcttgacttgtcgactacagtcgctgctcaggcacgagaataggaggtaagaaggtaacgtacgtatatatataaaatcgta

SEQ ID NO: 374 - DNA, 1000 bp, Saccharomyces cerevisiae
aacaatggaggacagcctcaaggtcaagctcagaattataataacagtggcaatgacaacaaagatagtactttgactagtatattcaaaatcttttgtaattgtatacaaagtttggcgtgaggataaatagagaataatcctaagactgtattttttttatagtaataaatgcgaaatcattagccacttattgaaagtttaaacttctatcgatacccacaaaaatactaaagaaataaaaaaaactattatcaatgaatttagttccgcgatgacgaatttaaggtgtgaacacacctcatcgctcaaatatataggaaatgatgatagctgtggtctacttttcaatacagaaataatcaggttattttcgctcaactgtttgttataatcatctaccaggctttgaaaggtttccctgtcatgtgtctcttgtgccacgaaattttgcgttgtgcaaaataactggctttccaaaaaggcaatcatttctttccatttcatcacttcattagttataaaaaggagttcccattgcaggagaaaataatcattgtttattgtcgctaattttctttccaataacgataactgcagtttccatttccaggtcgccaattggttggacaacgttgatgttaccttccttgttatggaaccatccatcattttctagttcttcttctgcaatattgccttttgggaagaaggatcgaaagtagccatttgcagacacgtttttactatatttactgtatcttcgattgcgcggctaaagttgccatattattattatattgcagctcaaccccgcatttccggagttttctttttttttatttggggtaatttggaggtcggcggctattggtgggccggaaatggtgacacacttgtaatatataaggaggaaatcctacatgtgtataagcgaaatcacaaggataataatgtattgctaaacaccctcaagaaagaaaataatcataacgaaatc

SEQ ID NO: 375 - DNA, 1000 bp, Saccharomyces cerevisiae
taaacataggatagattaaataagaaatcatatgaaaaaagaataaagtaagaaaatagttcaatgtatattcgtcagttcagggtgtgaaaaggtggcaatttttttgtttccgacccgtaacaagtgttcaatggtggtgaagtcttttcttggcaaatttctatacttcccaaattcttcatgaatataattcacaaaattaacttggttttcctttggttttgtatgagccgttcgtatggaagccctatacaggtgtaagacttctttttgtaacccacttaatctcttaggcatgctcttggtattgcgtctcctcttcttcttgtgtgtttaagctacattatctttgttaagaataatttggcgaacccctttttttcttcggctttgcaaggttaattaattaacatctaccagttttactacattttagattggttcgtccaccgaaatttaaaaaagcaggattgaaagcgtacaacaacgtcttagcgaaaaagataatccaaaattcgatgcttgtacacctcatgtagcttccttattaacatttggtagtaggcttaggctattttttgaaaaagccgtcatatattactttgagcctttgcgaatcctctccaaagtgtcggttacctaccgggagggataaccgcggatagccgtcatttaccgaaaattgccgaggtcatgctgagcatttgtcgtacttttgtgcggcggagctttgataccttcggtaagtgtcggtatgtaataggttagtggcatcttatttattgtgttgagtaaagtttaagatataaactgggctagtttgcatcgtcactacagcggcagctcactttcattttttttctgcgtttattaatactacataaaatctgatataaaacatatttaactgatcaaccctctcaacttgatactcaaaacaagttgacgcgacttctgtaaagtttatttacaagataacaaagaaactcccttaagc

SEQ ID NO: 376 - DNA, 1000 bp, Saccharomyces cerevisiae
agagcctcttatattcactctgttcctccatcgcctattgagaaacgttggaataaaactctaaaaatatcatctagttagttagtttttattttaccagtacattgtcacttgcggagggaggatgacataaagattgagacgcagtcatttaatgaagtttaaacgcgggtacttgataaagtaatacgatattgaatcatgacgtataaagtgaaatgaacgaatgattacgtaaaaatgtcgattttctcttgagagactcccatagcctctaagaggccttctactacgttccatatatctaagaatggggccatatccagtggaatcccagcaattatttgagaatcaccatttctcagccgatattttagcagaattactaccaatatcagggggcaatagttgatcgcctactttaacaaaaaatgttgctcacgtattaacacaggcaacaaaaaggatattacgcaagaacgtagtatccacatgccatcctccttgttgcatcttttttttccgaaatgattccctttcctgcacaacacgagatctttcacgcatacatcggaaggatcaccccccactcaagtcgttgcattgctaacatgtggcattctgcccatttttttcacgaaaattctctctctataatgaagacccttgtgccctggactctgtaatacttgaaactacttcctcaataatcgcttggagacctacccccacgcttttcaaacaaggcgctagcaaaaagcctgccgatatctccttgccccctcctcctgttcgagagaactacgacccgaccaataataatgtcatacaagaaccgccaagaaccaactgctgaaccttagatctccaatactttcagttggagtatgtgaatatataagtacctggtcgactaatcttcttgcatcttttcgtattcttacatcctatgtcgctaatacagttcccgcatagagaagaaagcaaacaaaagtagtca

SEQ ID NO: 377 - DNA, 1000 bp, Saccharomyces cerevisiae
tgaaaatagggccacatttatacggctgcaagaaaacttttactctctttctaccaagtttgttactgcaattaaataatctttatcatgggatagcgaaactaaaaactcatgagtggaaaagagagaatcgtagtttttcgagagctgttgatactttggatacttttttccaaacatcttatcaaactctaactgaggtacacctgtatcggtttgtgttttatatagcattccagcgtacagtacttgggcaggaggtagatcatgctttgaaacacagcaacacaacgctttcaatgagcattccttcaaagcccaaactcccgctatatattcatgcaatcgtggagttaagcagttttcttcgatgagaagattactgaaatgaaatctttccttttcatgcatgaacttccgtgttattttattcaaggtagaacggccacatgggtcgaatggggaatatttctctagtatatgtgcaaatcttggcaagtatacaatgtcaactcccactcctgctatcttacgtccaatattcctcgatgcaaaactcatcactggaggcattcaaagctagcacttatgaaataaacgttcattagaaagcaatactcctgataagaaaatagtgcttagcttctattcagccttcttaaagaactagcttttctatcaaaagtcagatctcttatgaccgcttgaacctgtggaatgtatataagcagttttgatgttaagatttttttttcaatagaatttcttccttcggaaataatcccgattaagaaattattcttgacgcaatattcagctatatgttgatcgggcttaaccgcataagtttcgttacccttttttaccccaatttttaatttcggcggttattttcagcccttttagagtcaagatatataagaatgcttctctaagaagtgagactaacaatgaaacccgtttcagacaatctggaagtcttagaacgcataacacagaa

SEQ ID NO: 378 - DNA, 1000 bp, Saccharomyces cerevisiae
accgcttcatatgtatattagacccttaatcattgaagatttaaagcagattttgaacttggaaagccaaggtttcccaccaaacgaaagagcttcagaagaaattatcagctttcgtttgatcaattgtccagagctatgttcaggtcttttcatcagagagatcgagggcaaagaagttaaaaaggagacactaattggtcatattatgggtactaagatacctcatgaatacattactatcgaaagcatgggcaaattacaagtggaatcgagtaatcatattggtattcactctgtagtaatcaagccagaataccagaaaaaaaacctggctactttacttttaactgactacattcagaaattgagtaatcaggaaattggtaacaaaattgtccttattgctcacgagccattgataccattttatgaaagagttggtttcaagatcattgctgagaacaccaatgttgctaaggacaaaaacttcgcagaacagaaatggatcgatatggagagagaactaattaaggaagaatacgacaactagatcattagtttaacgcactttacaaatgtctaattataaatactacatataatttttgtatattttaaaattgccaagtataattaaaatcattactactggtgctaccctacatccttgaccgtactgagatatcactgcttaattccggtgattgggttcttttcagttcttggagagatatacgtactaccttcctttttttttaaggatacctttactgtaaagggtttgttcctgtatcaaccccttcttcctgtacagaatctaagggaaccgtaaaagcacataagtatataaaggtcccaagatttgattaggtagatatggcctttgagttggctcttagttttttttggccttgaatacttgttcctacaatactccaacagcagttgaagccagaccgcagtatcacatatataatacacaggaatatatttgata

SEQ ID NO: 379 - DNA, 1000 bp, Saccharomyces cerevisiae
acgaagcatttgacgatcttcgcgacaggaatgatattcaaagactgcgaaaacttggttatgatgctgtctttcagaagcactccgacctttctgatgagtttttggagtcaagccgaaaatctttaaaactggaagaaagacagtttaatcgtcttgtggaaatgcttcttcttttaaacaattctccatcatttgaattaaaggtaaagaataggttgtacattaaaaattatgatgccctagatcaaactgatccagaaaaggcaagagaagctttacaaaattcatttattttagtcaaagatgattataggcgtattatagagtcgataaataaatctcaaggttaactgtttattaaatatataataacatatttatttgtttaacaagcctgaaataagaaattcttttataaatacatcatcgagatgatcatcaaagtgtctctatagttaatataagcttatgcaaaggttgaagccgttatgttgtcgtaattctaaattacaggttatattaaagagattatcttgactgatataaaatttcttatcatggtagtgatcacaaatagatcacatgatatattttttatttttaattttttttaattataaaaataatttttttctttaaattaaacaaaaataaaaaattgttttttgttggttaagatttccgaaaatagaaatattattcagttgaaagacaaaaaaacataaatatttctatgagcaaacaatttgaacagaaaaataaaattggggaagtgacacaccatggtagcggttctaaagcgaaatcggcaaagcggctaaatagcagttttgatgacttactccacactgaaaatggatgaccttaaataggagataaagctttttcatccctatgtatttaagatgactggcttgtcaagcattctaatcataaaaaaaagatcgtatttgatcaagaatttatacatagacgccgctaaataattgaatacaaa

SEQ ID NO: 380 - DNA, 1000 bp, Saccharomyces cerevisiae
tggaaatgtaaaggataatgagtgagcatataaaatggaagaaaaaataataataggattatgtataaaatatcgattcccttttgtagatttcgagatcttcgaggagaacttctagcacgttgtttacatatctaatgttgtaacacggcctttgttatcttgtgaatatatccatcacctacgtcgcttgaggtttcgtatcaaagaaagagagttcaaacataatcatacgtgtttcactccaaatttgatcacaaatggccacccattatagcttgttattatttacttcttcttgagttcattttattgaaagatgcccgctgggaacaaaacataaataaaattcaagagtacaatatagcgtagcatagttgcgagcaagggaaggcaacacagttaaaatgacaatgttagaaggaaaaactaaatcaagctcccataggaaatttcttgtgtcagtaatatgtctcgagaaaataataataattgaatctatttattgaaaagtaaatatctcgtaacccggatgctttgggcggtcgggttttgctactcgtcatccgatgagaaaaactgttcccttttgccccaggtttccattcatccgagcgatcacttatctgacttcgtcactttttcatttcatccgaaacaatcaaaactgaagccaatcaccacaaaattaacactcaacgtcatctttcactaccctttacagaagaaaatatccatagtccggactagcatcccagtatgtgactcaatattggtgcaaaagagaaaagcataagtcagtccaaagtccgcccttaaccaggcacatcggaattcacaaaacgtttctttattatataaaggagctgcttcactggcaaaattcttattatttgtcttggcttgctaatttcatcttatcctttttttcttttcacacccaaatacctaacaattgagagaaaactcttagcataacataacaaaaagtcaacgaaaa

SEQ ID NO: 381 - DNA, 1000 bp, Saccharomyces cerevisiae
atctgatacaatcgatcagtgcgtgcctttaatacttctctcattatagaacgatacctttgattcctagtttacaatacaacaatatcgaaaattctttcacgaatgcaccattcagaaggggaaagagtgactttacacaaaatttgtattggaataataatcaacgatcatgtgactactattcaaattactagtaagaaatcccaacaatcatcataaattcacctatttctgaatttaaagtccctttcatttcctattgaattattaatcgctacatttctgctattgtaaaattgatgacaatttatttagctgatttttcaatttacgctatcaattaaactactgtacgtgatactattctagcagcacagtagatttcactaacccgttatgttgagtagttatggtgcattaaaaattgagtacgtagcgataaaaaacaagaatattcaggaacttgagctaaggcaaggctggaagagaatcaatagtttctaaagtttttatcgttttgtttatgcttcgatatttttacttcgttcattttgatatctagaggcagcttcccttctgattctcccgagtctgttacggtaattgtttacataaacaaaaagagtatcctaatattcgatcacttctctcaagtcttgttgtaagccttaatttcttaatcttgtgtggttccggaagcctagttttaagtccgaaagtgatcgacggggaaatttgttaacgccgtatccgtactagaactctcggcggttatttgccaatttttactccaacggggatcaacatcagcaagaaagcaaaggaggatggggtaaaaaaacaaggaagacaagtaaagaaattatataagaagtcgtttctggctgctttactcccagtgttgaaaggtagaaggacttatcagctaatttattaagcaaggtacacatatacgaagctaaacaaacattcgatttatttcttatttgagtaagcc

SEQ ID NO: 382 - DNA, 1000 bp, Saccharomyces cerevisiae
ttcttttcagacccaagcaaacagaccaaaggacatttttttggaaaatgttaagaatcaaccctccgaaatcttttcacggctcaaattactgcggcctttttctgcttcttaaaaatgggagcatgattatttaattagcattgcatctgcgtgcaccgtaactactacagtacttttactgccgctgagacgacagcacgatctgttttaacgtcgtaggtgtatttttttttttcccgctaaaagagcaccgccataataatgacttacctcctccaatccttctagatgtttttctttaaactcctacagtgaattagattattgcaagtgcaaattaaaaaaaaacctaaaaaaaaaaaagaaggaaatagtttttgtccataccggactatggctttcattaacgaattagagcgccgctgttatccttttattaactttttatcgtgaatcatatctgcccctctctcggttgatagtataaatatgttggttttagtagcttattagtgtgcgcatgtcttttttcttgttcctggctattacaattcctgaaaatattcaaaagcgacactagcctaccttagttatactatgtctaacgaatctaacgaccttgaaaaaaacatttcgcacttggacccgaccggtgttgacaatgcttatattccacctgaacagccggaaacgaagcattcgcgttttaatattgacagagataccttaagaaaccactttatcgctgctgtgggtgagttttgcggtaccttcatgtttttatggtgtgcttacgtcatttgtaatgtcgctaaccatgatgtggctttgacaaccgagcctgagggctctcatccaggtcaattgatcatgattgcccttggtttcggtttctctgtgatgttttctatctggtgtttctggtggggctttgaacccagccgtttctctctctttgtgtttggccagagccatctcaccagccagatgtgtagtg

SEQ ID NO: 383 - DNA, 1000 bp, Saccharomyces cerevisiae
tccgtcataactttgaatcctgtcatgcatcaaagttgccccagcgttattctcaagaaaatgaatagatctaggcgtaacactgacaatcctgttcgtaaaataatctgggggtgaattataaaagtccgataatttatcttttaagtccaccatatcgactaaagttgtctttagatcttttaattgcggagaattcttaatcgatgcagctaaagtcaaacctgcaggacccccacctacgattaatacatctgttaactttggagctgaagatttggctgttgccaaacccctcaccaaaatacgccgagtaagcataacttttgaaaagaacatgcctctgtgtcaatcgatacaaggttcactgaaagaccaatttgagttactgaatgaagaaaattatcgccacaattatatttattcctttttaatgtcgtatcacaattccagaagggatatttctcagaaacagtttaagatctgcgtgttccttctgcaagaagaagggaaaaaaagaaaggagaaacaatagcagcataaatcttgttcgataaaacaacatcactttttcttgaaacttcaagggtttgcctccttagcttagtggtagagcgttgcacttgtaatgcaaaggtcgttagttcaattctgacaggtggcagtttcctttttatttgtcagtattaataattgaggcgcccctaatttttttggcaccgctctcgatgaaaaagtagagacgtcagaaattgaacgtttcctctaggagtttattaactaataaccccgaaaaatggctctttaaccacgagtgcccacggaggttatcttcacccctattttcattttaaattttagatcactgctaggagttagctcaaatatatatatatatatatatatggagacaacgtttgaagaattcgtaggtgcaggtgagcatattgccggataagtgtagttacgcaactacaattaaaaaaacacgaggaacaga

SEQ ID NO: 384 - DNA, 1000 bp, Saccharomyces cerevisiae
tttctaccgatgtaatacaaaaatgaatcatcaaaattttatgacgtaggaaaagacagagaaactttctatttcttttctggagtaaaaaattaattatctattttacttaaacgaagatagggtttcgtaatcacgaaagaacaagcaaaattctagttgacaggtcagttaaggcacagaaaaagaaatattattcattactatcaagataccgtagaaaagaaaaagaaccggggatgaataataacaaaacgggctgctttttctttttctctttctttttcatttggtccctctccactctttctccacgtggctttgctttccccgtatttttcttcgtcagagagactacatgatagtccaaagaaaagaaacggggggacgaagaagaggagaggaaaaaccaaaatataattttccgtgaaatagattctttttctccactgcacgacttcttctcctcccacaaaaaatgacgcctcatagacagccccgcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaagcagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacata

SEQ ID NO: 385 - skipped

SEQ ID NO: 386 - DNA, 1000 bp, Saccharomyces cerevisiae
tggcatcaaatttgggaaaatttagcttactcagacaccaacacattttttcatgagtattgttggaaaatctttccatgcttatcagccggaatacggaacaacggctgctgtgatgccgcaaaggggcaaggaaaaaataagcaacacacaccgaaacaggaggaagaaattccgaacacaagcctaagaagacaccgcagttgttgcaacatgttcacatgttcatccccctgctactacttggaaattaatgtaggggtaattggagtgcgccggcccgtgctttcagaggaacaaaggaagaattgttaaaaaaaggcagtgacaacgagcacgggtgcaccatatggtgtgataagcaacctaggacaaaaagaagtgcgcagttcctgtgtgcggcgccaagacaaatgtttcatatgcttctccaaggggctacgctacctagcctcaccacccgatctctttttttcctgaacgcagaggggaccgtacgaaaaaaaatgttttttaggcaacggagattcgttttatccacgtttaccccacaaaaagtgcaggtacattgtggggccccggcatcgaaaaccagtttttttcctttaaacgctggaaaaaaaggagaaattattggaactttgcagagaatagtccgtaggcaaattgaaaatgttccttaaaaaatttcgtttcttactcattgagattattcagatgccctccgtgccttcattgaaaaaaatccaagagatgtctcggatctgtatgcagattttggcttgcagacaatggagagcaaatgggtatacaatatagaaagcacagaaacatataaaaagagctcgagaaaagacatatggtttgtaactatcttcttcttttttccaatttttctgttttaataataaaaaaacaagaacaaacaagctcaacttgtcttttctaagaacaaagaataaacacaaaaacaaaaagtttttttaattttaatcaaaaa

SEQ ID NO: 387 - skipped

SEQ ID NO: 388 - DNA, 1000 bp, Saccharomyces cerevisiae
tcaacgatgttgccaaatagtcgtacctgaaaagcttaggttttccatttatgcgaatatctctatgcaaaataaattttaagtacctcaaaatttttttgcaccgatcaagatataataatcagatgagaatgaataaacaagacgcagatgaaggctgggcctccaacgaaacccagtacactgcagtaatttccaccaagaaacgcttggccttcgtaaagtcacttgcagcagcatagcggaaacaaggaagaaaaatatccgagtcagctggttccgggatttttttttgcccaataggaaaaacaatgcccaaaccggaaccatttcccgttttttctttcggtttatccgctttcttccaaaaaaatccgtacaaaatggaaaaacaatgtttatataatattccacatttttcctggcctgcgtctctttctgtggagaagaagatatttccctgagcagtttttttttctgacccctttttttttcccaccccccccggttttttttccatggggccccatattcccccgcctgcaggaaaacttggggaaagaggaaaaacacttcggataaaaacggtcaagaagctcttcgacgatttagtgccaccttcatgaaaaattccagagttttttccagctgctttgattttacagtccattattcggcgtctaacgattctgattaagaaacaacggaggaaaactcaaattctaatataatatttttaagtttatgaaggtggggtggtaagaaaagcaactaaaataatcttcaagtcaattagtggtgaaaagcttcaacactggggaatgaataatatgtcatctagaaaaaattttatataaatactcagtgttttattcattattctcgattcattcacttcaattcctcttcatgagtaatagaaaccataaagaaaagatatattcaaagcctcttatcaaggtttggttttgaaacacttttacaataaaatctgccaaaa

SEQ ID NO: 389 - DNA, 1000 bp, Saccharomyces cerevisiae
ctaatagacaaggtgctatgagtgaattgctagcctcccctttttattttgtgcggtcaccgcaagggacaaagcttttcttagaaaaccgtctgagaagcataacgtacgccatcccctagacatattaataatgctacagatactatgctgctcgtctttttttgacgacccttttattgcaatgtgcaactaatggcaaacaaccacatagtatcacagtattacattgcctccaccgatgcggatgttagggcgccaagtctgtcatgaagcatgttcctgtcataatcttgtatgcaaaataccgcgttctgcgccactgatatgctaggcagcagcaacctatgcagaagattgcttttcccacgcctgttttacgtctccagggcacttgaaacaatgcagcgatcgccgccacaacacgccaaagagaagcgaaagtgggcctgggcggcctcagtttcggcagaggtaaacaacacgaactgaactgccttagctccgaagggcaattccacaggcactccgcggggcccggccaaggcccaaaaggcgtggaatatgcgcgttttggggccataacacccagtaccacggccggaacgggccatataataagtttttcactctcaagaatggtaaacgtaaataggaacatcccactaccctagaaattgcggaaatttcgcgcttatcattagaaaatctggaaccgtcctttttcctctttcttgcatttccctttccgtattattgccattctttaactgcatttggggaaccgtagaccaaaagccaaacagagaaatgtaacgttctaaaaaaaaaacaacgaaaaaattgaaaaataagatacaataatcgtatataaatcaggcttcttgttcatcattttcaattctcttcttgccatcccttttcctatctttgttcttttcttctcataatcaagaataaataacttcatcacattcgctacacactaacaagaaaaaaa

SEQ ID NO: 390 - DNA, 1000 bp, Saccharomyces cerevisiae
tgtttcaattcatcgtatttcaatggatactcttcgtatcgttctgcactaaaaagcaaagggttcgctcttctcgagagctctagatcaaatttatgcatatgaaacgtgatatccaccgttattctccctctcgaacacaggacttcgatagtatcttttgtaatctgttcagctcaactatttgttaccataccatcatcatcactttacacatactcatcatgtgtttattgacgcgagcgcgacttgcaagaaaaggcataattgtggcgaggtaatgaaaaatttttgacgtttccctcattcattcatacataacattttgggattttggaacaaggcgagaggagaacgtctttggaccactgtaatagtacacaatgcaagatattttaagtttatgctaaaaatccagaagtgacgcttcatcaacggtgtcaatatggaccgaattttagtgtatcttcaattgtaaccgtgaggagtagactctttgaatacgggggaagaagaaatatcatattcaaagctaattcattgaaattagtgcttgtctcatctagcctttagtgcttaatctctggaggagcacatatggggttaaagccatgccgggactgggggcccctatcggggctcgaacccgaatcccgcgagtatttatttgaaggtccgggacgcaagttacctaatctggttaattgatatcccatttaggcgatgacgttccttcccctcacccctcggcttgttagaagatctattgttatagcctcctctggaagaatttatgccagatgaagaaaaaaacttctcgaagttcccagatgcccaaatgagggctttccatccctgttagctggaaaagtgtaagtatatctatataaaaagtcggcctacttttgccaggttcgtctttcacttgcactctcttgatcttactttctactcaaaaagaatccaatacacaaaaataaaatcagtactattactaata

SEQ ID NO: 391 - DNA, 1000 bp, Saccharomyces cerevisiae
cgttggactttttttaatataacctaccataggacacactttgttgttgatgttggacaattcgttaattaagagtccctaaacggctctactagttccaacctcactttgttttttcatttttttatgttttttctagaaccttctttacgtgattctcgctcggaatccgtcaatagaatgttttcagtctccgtttcaatattctgcgcacatcaatcattttcttactacatacactaacattactcctagtttaatttaattgaatttttaactttcttttcttttcatttggcaatttggctccttgaaaacaagactatgggtctctctcataagcctcagggggggaccccaaaaaaataacgcggccatcttgcatgcaccgttgaacctgtagcttacagtaagccacaattctcttaccttcttggcaatgtggcacaaaataatctggttatgtgtcttcatttggtaatcactgggatgttactggggcagcagcaactccgtgtgtacccctaactccgtgtgtacccctaaagaaccttgcctgtcaaggtgcattgttggatcggaatagtaaccgtctttacatgaacatccacaaccaacgaaagtgctttttcaagcattgcttgatttctagaaagatcgatggttattccctcccccttatgcgtccaaaaatatagggtgctcgtaacagtaaggtattcgcacttagcgtgctcgcaacacaaaattaagtaatatgcgagttttagatgtccttgcggatctatgcacgttcttgagtggtatttcataacaacggttctttttcacccttattcctaaacatataaataggacctccattagttagagatctgtttttaatccattcacctttcattctactctcttatactaataaaaccaccgataaagatatatcagatctctattaaaacaggtatccaaaaaagcaaacaaacaaactaaacaaattaac

SEQ ID NO: 392 - DNA, 1000 bp, Saccharomyces cerevisiae
tttccaatcagagcaagagtagcaaggcttctaaaagcccgaagtggtcgagctacgcattcccttcgcgtgagaccatcaaatctcatgaggaggccatcaagaagcagaataaagctatagacgagcaaatagctgctgcagtatccaagaatgactgctcttgcacagaacctcccaagaaaagaaagaggaaattgagaccaagaaaggcgctgatcaccctgagtccgaaggcaatcaagcatttaagggcactgctagctcagccggaacctaaattgattagagttagcgctagaaaccgtggatgttcaggactaacgtacgatctacaatatatcaccgagccggggaaattcgatgaggtagtagaacaagatggcgttaaaattgtcatcgattcaaaggcgttattcagcatcattggaagtgaaatggactggatcgacgacaagttggcctctaagtttgtcttcaagaatccaaactccaagggcacatgcggttgtggcgagagtttcatggtttaaaaaccttctgcaccatttttagaaaaaaagaatctacctattcacttatttattcatttacttatttatttacatatttatcatacatattaacattgaaccctccatcgtggtagtgtttgctgttcctaacttttctttcgttgttcttgtagatatatatttttccagaattttctagaagggttattaattacaatcttaaacgttccataaggggccgcgatttttttgttcaattttcaacagggggcccatctcaaagaactgcaaattatatcacagtaaaaggcaaaggggcgcaaacttatgcaacctgccagattattatataaggcattgtaatcttgcctcaattccttcataattcgttcctttgtcacttgttcctttttacccttgaatcgaatcagcaataacaaagaaaaaagaaatcaactacacgtaccataaaatatacagaatat

SEQ ID NO: 393 - DNA, 1000 bp, Saccharomyces cerevisiae
aatatgtaatagttatgcactttaattcttttgttcatctagaagacaatacaacgcatttcttggctaaccatcttacagccttgagggtaaagggcgggcaaacgaacaaaagtacaaaatttccatccttgtttgataatcatttcctcggaccagataagaatgagcagccgaaataaacggtaacgtgattaaaaccgctagaagagtgtttttgtaaggatgaaaacctcagtgagaaagttgacaatataaacattatcagcttttctcgccctcttttgcacttcctgcaacattacttgttctgcagcttgtttcttccaaatatatccatgctctcggtgtgccacttctggggtttctcaccaataacagaacatatccagtataatacatacaccatattcacaccctatttcatatcattaacctcttcatttttaaatgccagcgattactttgacttctaatcaagaacgcgaaaaaaaattaccgcgtgaactatgtcatatttgcgattttaggtacaataaatattatcattattatattatgtttgcatgtaggttctacaaatacattgttgtacgctatagtttcctttcaaaactagaaagaattcgtaacaaaataatctccaatattttatagcaccttattaatatcaatgctgcaataccttctcatttcaacaattggccctcacctcttttgtacaaaaaacgtcgccattgataaaataagtaagaagcatataattggaatgtccattacgtaaaagaaaaaaaatcatgtgtacatattacgtaatagaatacggaattttctcgcggaagtagatcttccgtggaaaaaaaggaaaaagtccgatcaatattgaaaaagggatccttagtttcccaactatataaggaggaaaagtctatctctgtagcgttgatataacgtgtacgattttcaaacaaacagatagcagtatcacacgcccgtaaat

SEQ ID NO: 394 - DNA, 1000 bp, Saccharomyces cerevisiae
cgttaacgtaaatatgtcttcctctttgattccaacaatgatattataaggaaattatcgtcacaatctaatcaacaaggacaaagaaaagaaaaagttgagagagagaacaaaagttcaaatcaaagaaaaaaaagaacatcaaattacctattacaataaacaattaagccatactcgcaacaatttgccataatagaaagcagcacctcgttggcgcagtcccttacatagtacacaacatttatcacttcacacaatcaggagtggaactcaatggaaaacaacaccacacgtatgatcttactaataaaagaacatgaacgttcctcagcgcgaacgttcgcattctgcgccttcgagcacaggataagttgcaggaagccatcacatctatgcaacgattatcacgacacaaccttgccgccgagaaaacgtccgtggagaaccattcggtcgattgcttcccacggaacgagtggactgaaacttaagactgcccctctctttccgcggaatcgctcatgccgcggtgccacaacattttcagatttactaagactccggtgagtgtgggctcacccgcgggtcgtgatcacgattcagcaccctttggactcgtgattccgtggaaaggtcagatctgtattcctacttatggtaatgtgctaaaaaaagagaaatgtctccgcggaactcttctacgccgtggtacgatatctgttgaacgtaatctgagcaatacaaacaaggcctctcctatacatatataattgtgatgtgcataaccttatggctgttcgcttttattatcataccttagaatgaaatccaaaagaaaaaagtcacgcaaagttgcaaacatataacaactgtgttagttatcactcgactttgttattctaattataaataaattggcaactaggaactttcgaaaaagaaattaaagacccttttaagttttcgtatccgctcgttcgaaagactttagacaaaa

SEQ ID NO: 395 - DNA, 12 bp, Saccharomyces cerevisiae
yyyattgttctc

SEQ ID NO: 396 - skipped

SEQ ID NO: 397 - protein, 148 aa, Saccharomyces cerevisiae
MLSNAKLLLSLAMASTALGLVSNSSSSVIVVPSSDATIAGNDTATPAPEPSSAAPIFYNSTATATQYEVVSEFTTYCPEPTTFVTNGATFTVTAPTTLTITNCPCTIEKPTSETSVSSTHDVETNSNAANARAIPGALGLAGAVMMLL

SEQ ID NO: 398 - DNA, 1335 bp, Saccharomyces cerevisiae
atgcaattacattcacttatcgcttcaactgcgctcttaataacgtcagctttggctgctacttcctcttcttccagcataccctcttcctgtaccataagctcacatgccacggccacagctcagagtgacttagataaatatagccgctgtgatacgttagtcgggaacttaactattggtggtggtttgaagactggtgctttggctaatgttaaagaaatcaacgggtctctaactatatttaacgctacaaatctaacctcattcgctgctgattccttggagtccatcacagattctttgaacctacagagtttgacaatcttgacttctgcttcatttgggtctttacagagcgttgatagtataaaactgattactctacccgccatctccagttttacttcaaatatcaaatctgctaacaacatttatatttccgacacttcgttacaatctgtcgatggattctcagccttgaaaaaagttaacgtgttcaacgtcaataacaataagaaattaacctcgatcaaatctccagttgaaacagtcagcgattctttacaattttcgttcaacggtaaccagactaaaatcaccttcgatgacttggtttgggcaaacaatatcagtttgaccgatgtccactctgtttccttcgctaacttgcaaaagattaactcttcattgggtttcatcaacaactccatctcaagtttgaatttcactaagctaaacaccattggccaaaccttcagtatcgtttccaatgactacttgaagaacttgtcgttctctaatttgtcaaccataggtggtgctcttgtcgttgctaacaacactggtttacaaaaaattggtggtctcgacaacctaacaaccattggcggtactttggaagttgttggtaacttcacctccttgaacctagactctttgaagtctgtcaagggtggcgcagatgtcgaatcaaagtcaagcaatttctcctgtaatgctttgaaagctttgcaaaagaaagggggtatcaagggtgaatcttttgtctgcaaaaatggtgcatcatccacatctgttaaactatcgtccacttccaaatctcaatcaagccaaactactgccaaggtttccaagtcatcttctaaggccgaggaaaagaagttcacttctggcgatatcaaggctgctgcttctgcctctagtgtttctagttctggcgcttccagctctagctctaagagttccaaaggcaatgccgctatcatggcaccaattggccaaacaacccctttggtcggtcttttgacggcaatcatcatgtctataatgtaa

SEQ ID NO: 399 - protein, 444 aa, Saccharomyces cerevisiae
MQLHSLIASTALLITSALAATSSSSSIPSSCTISSHATATAQSDLDKYSRCDTLVGNLTIGGGLKTGALANVKEINGSLTIFNATNLTSFAADSLESITDSLNLQSLTILTSASFGSLQSVDSIKLITLPAISSFTSNIKSANNIYISDTSLQSVDGFSALKKVNVFNVNNNKKLTSIKSPVETVSDSLQFSFNGNQTKITFDDLVWANNISLTDVHSVSFANLQKINSSLGFINNSISSLNFTKLNTIGQTFSIVSNDYLKNLSFSNLSTIGGALVVANNTGLQKIGGLDNLTTIGGTLEVVGNFTSLNLDSLKSVKGGADVESKSSNFSCNALKALQKKGGIKGESFVCKNGASSTSVKLSSTSKSQSSQTTAKVSKSSSKAEEKKFTSGDIKAAASASSVSSSGASSSSSKSSKGNAAIMAPIGQTTPLVGLLTAIIMSIM

SEQ ID NO: 400 - DNA, 1017 bp, Saccharomyces cerevisiae
atgaaattatcaactgtcctattatctgccggtttagcctcgactactttggcccaattttccaacagtacatctgcttcttccaccgatgtcacttcctcctcttccatctccacttcctctggctcagtaactatcacatcttctgaagctccagaatccgacaacggtaccagcacagctgcaccaactgaaacctcaacagaggctccaaccactgctatcccaactaacggtacctctactgaagctccaaccactgctatcccaactaacggtacctctactgaagctccaactgatactactactgaagctccaaccaccgctcttccaactaacggtacttctactgaagctccaactgatactactactgaagctccaaccaccggtcttccaaccaacggtaccacttcagctttcccaccaactacatctttgccaccaagcaacactaccaccactcctccttacaacccatctactgactacaccactgactacactgtagtcactgaatatactacttactgtccagaaccaaccactttcaccacaaacggtaagacttacaccgtcactgaaccaaccacattgactatcactgactgtccatgcaccattgaaaagccaacaaccacatcaaccaccgaatacactgtagtcactgagtacactacttactgtccagaaccaaccactttcaccacaaacggtaagacttacaccgtcactgaaccaaccactttgactatcactgactgtccatgtactattgaaaagagcgaagcccctgagtcttctgtcccagttaccgaatctaagggcactaccaccaaagaaacaggtgttactaccaaacaaaccacagccaacccaagtctaaccgtctccacagtcgtcccagtttcatcctctgcttcttctcattccgttgtcatcaacagtaacggtgctaacgtcgtcgttccaggtgctttaggtttggctggtgttgctatgttattcttataa

SEQ ID NO: 401 - protein, 338 aa, Saccharomyces cerevisiae
MKLSTVLLSAGLASTTLAQFSNSTSASSTDVTSSSSISTSSGSVTITSSEAPESDNGTSTAAPTETSTEAPTTAIPTNGTSTEAPTTAIPTNGTSTEAPTDTTTEAPTTALPTNGTSTEAPTDTTTEAPTTGLPTNGTTSAFPPTTSLPPSNTTTTPPYNPSTDYTTDYTVVTEYTTYCPEPTTFTTNGKTYTVTEPTTLTITDCPCTIEKPTTTSTTEYTVVTEYTTYCPEPTTFTTNGKTYTVTEPTTLTITDCPCTIEKSEAPESSVPVTESKGTTTKETGVTTKQTTANPSLTVSTVVPVSSSASSHSVVINSNGANVVVPGALGLAGVAMLFL

SEQ ID NO: 402 - DNA, 1524 bp, Saccharomyces cerevisiae
atgaaagtgcttgacctactaacggtactcagtgcctcttcattattatctacattcgcggctgccgaaagtactgctactgcagacagtacaactgcagcttctagcactgcttcgtgtaacccgttaaaaactacaggttgtacgccggatacagctttggcaactagttttagcgaagatttctcatcttcatccaaatggtttaccgacttgaagcacgcaggtgaaatcaagtacggttcagacggtttgtcaatgacactggcgaaaagatacgataatccaagtttgaagtctaacttttatatcatgtatggtaaattggaagttatcttaaaagctgccaatggtaccggtattgtttcatcattctatttacaaagtgatgatttggatgaaattgatattgaatgggtgggtggtgacaacactcagttccaatctaacttcttttctaaaggtgataccacaacatacgacagaggcgaatttcacggtgtcgacactcctaccgacaaatttcataactacactttagattgggcgatggacaagacgacttggtacctcgatggagagtctgtcagagtattatcaaacacatcaagtgagggttacccacaatctcctatgtacctaatgatgggtatctgggccggtggtgacccagacaatgctgctggtaccattgaatgggctggtggtgaaaccaactacaatgacgctccattcactatgtacattgaaaaggtcattgtaactgattattctaccggtaaaaagtacacatatggtgaccaatctggttcttgggaatctattgaagctgacggtggttctatttacggcaggtatgaccaagcccaagaagatttcgcagttttagccaacggtggtagtatttccagcagctctacatcctcttctactgtatcttcctcggcgtcttccactgtatcttcctcggtttcttccactgtgtcctcctcggcttcttccactgtgtcttcctcggtttcttccactgtatcttcttcgtcttctgtatcttcctcttcatccacatctccatcttcttcgaccgctacttcatctaaaacacttgcttcctcatcagtcaccacatctagttccattagttcattcgaaaagcaatcctcctcttcatccaagaaaacagtggcttcctcttctacaagtgagtccattatttcctccactaagaccccagccactgtttcctctaccactaggtctacagttgccccaactactcaacaatcttccgtatcatcggacagtcctgtacaagataagggtggtgtcgcaacatcaagtaatgacgtgaccagttctactacccagatatcaagcaaatacacatctacaatccaaagttcttcctccgaagccagctcgacaaactctgttcaaatttctaacggtgctgatttagctcagagtttaccaagagagggaaaacttttttccgtactcgtagctttactagccttgctataa

SEQ ID NO: 403 - protein, 507 aa, Saccharomyces cerevisiae
MKVLDLLTVLSASSLLSTFAAAESTATADSTTAASSTASCNPLKTTGCTPDTALATSFSEDFSSSSKWFTDLKHAGEIKYGSDGLSMTLAKRYDNPSLKSNFYIMYGKLEVILKAANGTGIVSSFYLQSDDLDEIDIEWVGGDNTQFQSNFFSKGDTTTYDRGEFHGVDTPTDKFHNYTLDWAMDKTTWYLDGESVRVLSNTSSEGYPQSPMYLMMGIWAGGDPDNAAGTIEWAGGETNYNDAPFTMYIEKVIVTDYSTGKKYTYGDQSGSWESIEADGGSIYGRYDQAQEDFAVLANGGSISSSSTSSSTVSSSASSTVSSSVSSTVSSSASSTVSSSVSSTVSSSSSVSSSSSTSPSSSTATSSKTLASSSVTTSSSISSFEKQSSSSSKKTVASSSTSESIISSTKTPATVSSTTRSTVAPTTQQSSVSSDSPVQDKGGVATSSNDVTSSTTQISSKYTSTIQSSSSEASSTNSVQISNGADLAQSLPREGKLFSVLVALLALL

SEQ ID NO: 404 - DNA, 720 bp, Saccharomyces cerevisiae
atgaaattctccactgctttgtctgtcgctttattcgccttggctaagatggtcattgccgattccgaagaattcggcctggtgagtatccgttccggctcggatttacaatacttgagtgtttacagtgataacggcactttgaaacttggcagcggtagtggctcatttgaggcaactattaccgatgacggtaaactgaaatttgacgacgataagtatgctgttgtcaatgaggatggctcattcaaagaaggttctgagagcgatgctgccactggtttttctattaaagatggccatctaaactacaagagctcttctggtttctacgctatcaaggacgggtcgtcttacattttctcttctaagcaatccgacgacgctaccggtgttgcgattagaccaactagtaagagcggatctgttgcagcagatttttctccaagcgactctagttcctcttcatctgcttctgcttcgtctgcttccgcatcatcttctacaaagcatagttcgagtatagaatctgtcgagacctctactactgtggaaacttcctctgctagctccccaactgcttcagttatctctcaaattactgatggacaaatccaagctccaaacacagtttacgaacaaacagaaaatgcaggtgccaaggctgccgtcggcatgggtgctggtgctctagcggtcgcagctgcttacttgttgtaa

SEQ ID NO: 405 - protein, 239 aa, Saccharomyces cerevisiae
MKFSTALSVALFALAKMVIADSEEFGLVSIRSGSDLQYLSVYSDNGTLKLGSGSGSFEATITDDGKLKFDDDKYAVVNEDGSFKEGSESDAATGFSIKDGHLNYKSSSGFYAIKDGSSYIFSSKQSDDATGVAIRPTSKSGSVAADFSPSDSSSSSSASASSASASSSTKHSSSIESVETSTTVETSSASSPTASVISQITDGQIQAPNTVYEQTENAGAKAAVGMGAGALAVAAAYLL

SEQ ID NO: 406 - skipped

SEQ ID NO: 407 - protein, 254 aa, Saccharomyces cerevisiae
MKACSILFTTLITLAAAQKDSGSLDGQNSEDSSQKESSNSQEITPTTTKEAQESASTVVSTGKSLVQTSNVVSNTYAVAPSTTVVTTDAQGKTTTQYLWWVAESNSAVSTTSTASVQPTGETSSGITNSASSSTTSTSTDGPVTIVTTTNSLGETYTSTVWWLPSSATTDNTASSSKSSSGSSSKPESSTKVVSTIKSTYTTTSGSTVETLTTTYKSTVNGKVASVMSNSTNGAFAGTHIAYGAGAFAVGALLL

SEQ ID NO: 408 - DNA, 1026 bp, Saccharomyces cerevisiae
atgcaatacaaaaaatcattagttgcctccgccttagttgctacatctttagctgcctatgctccaaaggacccgtggtccactttaactccatcagctacttacaagggtggtataactgattactcttctactttcggtattgctgttgaaccaattgccactactgcttcctccaaggctaagagagccgctgctatctctcaaattggtgacggtcaaatccaagccactaccaaaaccactgctgctgctgtttctcaaattggtgacggtcaaatccaagccactactaaaaccaaagctgctgctgtctctcaaattggtgacggccaaatccaagccaccaccaagactacctcagctaagactaccgctgcagccgtctcccaaattggtgacggtcaaattcaagccactactaaaaccaaagctgctgctgtctctcaaattggtgacggtcaaatccaagccactaccaaaacaactgctgcagctgtctctcaaattggtgacggtcaaatccaagccactactaaaaccactgctgctgctgtttctcaaattggtgacggtcaaatccaagccaccaccaatactactgttgctccagtctcccaaatcactgatggccaaatccaagccacaactttaacttctgcaaccattataccatctccagctccagctccaattactaatggcactgacccagtaactgctgaaacatgtaaaagcagtggcactttagaaatgaacttaaagggtggtatcctgactgacggtaaaggtagaattggttctatcgttgccaacagacaattccaattcgatggtcctccaccacaagctggtgctatctatgctgctggttggtccatcaccccagaaggtaacttggccatcggtgaccaggatactttttaccaatgtttgtcaggaaacttctacaacttatacgatgagcacattggaactcaatgtaatgcagtccacctacaagctatcgatttgctcaactgttaa

SEQ ID NO: 409 - protein, 341 aa, Saccharomyces cerevisiae
MQYKKSLVASALVATSLAAYAPKDPWSTLTPSATYKGGITDYSSTFGIAVEPIATTASSKAKRAAAISQIGDGQIQATTKTTAAAVSQIGDGQIQATTKTKAAAVSQIGDGQIQATTKTTSAKTTAAAVSQIGDGQIQATTKTKAAAVSQIGDGQIQATTKTTAAAVSQIGDGQIQATTKTTAAAVSQIGDGQIQATTNTTVAPVSQITDGQIQATTLTSATIIPSPAPAPITNGTDPVTAETCKSSGTLEMNLKGGILTDGKGRIGSIVANRQFQFDGPPPQAGAIYAAGWSITPEGNLAIGDQDTFYQCLSGNFYNLYDEHIGTQCNAVHLQAIDLLNC

SEQ ID NO: 410 - DNA, 1242 bp, Saccharomyces cerevisiae
atgcaatacaaaaagactttggttgcctctgctttggccgctactacattggccgcctatgctccatctgagccttggtccactttgactccaacagccacttacagcggtggtgttaccgactacgcttccaccttcggtattgccgttcaaccaatctccactacatccagcgcatcatctgcagccaccacagcctcatctaaggccaagagagctgcttcccaaattggtgatggtcaagtccaagctgctaccactactgcttctgtctctaccaagagtaccgctgccgccgtttctcagatcggtgatggtcaaatccaagctactactaagactaccgctgctgctgtctctcaaattggtgatggtcaaattcaagctaccaccaagactacctctgctaagactaccgccgctgccgtttctcaaatcagtgatggtcaaatccaagctaccaccactactttagccccaaagagcaccgctgctgccgtttctcaaatcggtgatggtcaagttcaagctaccaccactactttagccccaaagagcaccgctgctgccgtttctcaaatcggtgatggtcaagttcaagctactactaagactaccgctgctgctgtctctcaaattggtgatggtcaagttcaagctaccaccaagactactgctgccgccgtttctcaaatcggtgatggtcaagttcaagctactaccaagactaccgctgctgctgtctctcaaatcggtgatggtcaagttcaagcaactaccaaaaccactgccgcagctgtttcccaaattactgacggtcaagttcaagccactacaaaaaccactcaagcagccagccaagtaagcgatggccaagtccaagctactactgctacttccgcttctgcagccgctacctccactgacccagtcgatgctgtctcctgtaagacttctggtaccttagaaatgaacttaaagggcggtatcttaactgacggtaagggtagaattggttctattgttgctaacagacaattccaatttgacggtccaccaccacaagctggtgccatctacgctgctggttggtctataactccagacggtaacttggctattggtgacaatgatgtcttctaccaatgtttgtccggtactttctacaacttgtacgacgaacacattggtagtcaatgtactccagtccacttggaagctatcgatttgatagactgttaa

SEQ ID NO: 411 - protein, 413 aa, Saccharomyces cerevisiae
MQYKKTLVASALAATTLAAYAPSEPWSTLTPTATYSGGVTDYASTFGIAVQPISTTSSASSAATTASSKAKRAASQIGDGQVQAATTTASVSTKSTAAAVSQIGDGQIQATTKTTAAAVSQIGDGQIQATTKTTSAKTTAAAVSQISDGQIQATTTTLAPKSTAAAVSQIGDGQVQATTTTLAPKSTAAAVSQIGDGQVQATTKTTAAAVSQIGDGQVQATTKTTAAAVSQIGDGQVQATTKTTAAAVSQIGDGQVQATTKTTAAAVSQITDGQVQATTKTTQAASQVSDGQVQATTATSASAAATSTDPVDAVSCKTSGTLEMNLKGGILTDGKGRIGSIVANRQFQFDGPPPQAGAIYAAGWSITPDGNLAIGDNDVFYQCLSGTFYNLYDEHIGSQCTPVHLEAIDLIDC

SEQ ID NO: 412 - DNA, 978 bp, Saccharomyces cerevisiae
atgcaatataaaaagccattagtcgtctccgctttagctgctacatctttagctgcctatgctccaaaggacccgtggtccactttaactccatcagctacttacaagggtggtataacagattactcttcgagtttcggtattgctattgaagccgtggctaccagtgcttcctccgtcgcctcatctaaagcaaagagagccgcctctcagataggtgatggtcaagtacaggctgccactactactgctgctgtttctaagaaatccaccgctgctgctgtttctcaaataactgacggtcaagttcaagctgctaagtctactgccgctgctgtttcccaaataactgacggtcaagttcaagctgctaagtctactgccgctgccgtttctcaaataactgacggtcaagttcaagctgctaagtctactgccgctgccgtttctcaaataactgatggtcaagttcaagctgccaagtctactgctgccgctgcctctcagatttctgacggccaagttcaggccactacctctactaaggctgctgcatcccaaattacagatgggcagatacaagcatctaaaactaccagtggcgctagtcaagtaagtgatggccaagtccaggctactgctgaagtgaaagacgctaacgatccagtcgatgttgtttcctgtaataacaatagtaccttgtcaatgagtttaagcaagggtatcttaaccgataggaagggtagaattggctctatcgttgccaacagacagttccaattcgatggtcctccaccacaagctggtgctatctatgctgctggttggtccatcaccccagaaggtaacttagctcttggtgaccaggatactttttaccaatgtttgtctggtgacttctataacttgtatgataagcacattggttctcagtgccatgaagtttatttgcaagctatagatttaattgactgttga

SEQ ID NO: 413 - protein, 325 aa, Saccharomyces cerevisiae
MQYKKPLVVSALAATSLAAYAPKDPWSTLTPSATYKGGITDYSSSFGIAIEAVATSASSVASSKAKRAASQIGDGQVQAATTTAAVSKKSTAAAVSQITDGQVQAAKSTAAAVSQITDGQVQAAKSTAAAVSQITDGQVQAAKSTAAAVSQITDGQVQAAKSTAAAASQISDGQVQATTSTKAAASQITDGQIQASKTTSGASQVSDGQVQATAEVKDANDPVDVVSCNNNSTLSMSLSKGILTDRKGRIGSIVANRQFQFDGPPPQAGAIYAAGWSITPEGNLALGDQDTFYQCLSGDFYNLYDKHIGSQCHEVYLQAIDLIDC

SEQ ID NO: 414 - DNA, 684 bp, Saccharomyces cerevisiae
atgcaattcaaaaacgtcgccctagctgcctccgttgctgctctatccgccactgcttctgctgaaggttacactccaggtgaaccatggtccaccttaaccccaaccggctccatctcttgtggtgctgccgaatacactaccacctttggtattgctgttcaagctattacctcttcaaaagctaagagagacgttatctctcaaattggtgacggtcaagtccaagccacttctgctgctactgctcaagccaccgatagtcaagcccaagctactactaccgctaccccaaccagctccgaaaagatctcttcctctgcatctaaaacatctactaatgccacatcatcttcttgtgccactccatctttgaaagatagctcatgtaagaattctggtaccttagaattgaccttgaaggacggtgttttgactgatgccaagggtagaattggttctattgttgctaacagacaattccaatttgacggtccaccaccacaagccggcgccatctacgctgccggttggtccattactgaagatggttacttggctttgggtgacagtgacgttttctaccaatgtctatccggcaatttctacaacttgtatgatcaaaacgtcgccgaacaatgtagtgccattcatttggaagctgtttctttggtcgactgttaa

SEQ ID NO: 415 - protein, 227 aa, Saccharomyces cerevisiae
MQFKNVALAASVAALSATASAEGYTPGEPWSTLTPTGSISCGAAEYTTTFGIAVQAITSSKAKRDVISQIGDGQVQATSAATAQATDSQAQATTTATPTSSEKISSSASKTSTNATSSSCATPSLKDSSCKNSGTLELTLKDGVLTDAKGRIGSIVANRQFQFDGPPPQAGAIYAAGWSITEDGYLALGDSDVFYQCLSGNFYNLYDQNVAEQCSAIHLEAVSLVDC

SEQ ID NO: 416 - DNA, 942 bp, Saccharomyces cerevisiae
atgcgtttctctactacactcgctactgcagctactgcgctatttttcacagcctcccaagtttcagctattggtgaactagcctttaacttgggtgtcaagaacaacgatggtacttgtaagtccacttccgactatgaaaccgaattacaagctttgaagagctacacttccaccgtcaaagtttacgctgcctcagattgtaacactttgcaaaacttaggtcctgctgctgaagctgagggatttactatctttgtcggtgtttggccaacagacgacagtcattacgctgctgaaaaggctgctttgcaaacctatttgccaaaaattaaagaatccactgttgctggtttcttggttggttctgaagccttataccgtaacgatttgactgcctctcaattatcagacaaaattaatgacgtccgtagtgtcgttgctgacatttccgattctgacggaaagtcatactctggtaagcaagtcggtactgtcgattcctggaatgttttggttgctggttacaattctgccgttatcgaagcttccgattttgttatggctaacgcgttctcctactggcaaggtcaaaccatgcaaaatgcctcttactcattctttgatgatattatgcaagctctacaggttatccaatctactaaaggttctaccgatattaccttctgggttggtgagaccggttggccaactgatggtaccaactttgaaagttcttacccatctgttgacaacgccaaacaattctggaaagaaggtatctgttccatgagagcttggggtgttaacgttattgtttttgaagcctttgatgaagattggaagccaaacacctctggtacctctgatgtcgagaagcactggggtgttttcacttcaagtgacaatttgaaatactccttggactgtgacttttcatga

SEQ ID NO: 417 - protein, 313 aa, Saccharomyces cerevisiae
MRFSTTLATAATALFFTASQVSAIGELAFNLGVKNNDGTCKSTSDYETELQALKSYTSTVKVYAASDCNTLQNLGPAAEAEGFTIFVGVWPTDDSHYAAEKAALQTYLPKIKESTVAGFLVGSEALYRNDLTASQLSDKINDVRSVVADISDSDGKSYSGKQVGTVDSWNVLVAGYNSAVIEASDFVMANAFSYWQGQTMQNASYSFFDDIMQALQVIQSTKGSTDITFWVGETGWPTDGTNFESSYPSVDNAKQFWKEGICSMRAWGVNVIVFEAFDEDWKPNTSGTSDVEKHWGVFTSSDNLKYSLDCDFS

SEQ ID NO: 418 - DNA, 1455 bp, Saccharomyces cerevisiae
atggctgataagatagagaggcatactttcaaggtcttcaatcaagatttcagtgtagataagaggtttcaacttatcaaagaaatagggcatggagcatacggcatagtgtgttcagcgcggtttgcagaagctgccgaagataccacagttgccatcaagaaagtgacaaacgttttttcgaagaccttactatgtaaaagatccctacgtgagctaaagcttttgagacatttcagaggccacaaaaatattacatgtctttatgatatggatattgttttttatccagacgggtctatcaatggactatatctttatgaggaacttatggaatgtgatatgcaccaaatcatcaaatccggtcaacctttgacggatgctcactatcaaagtttcacataccaaatattatgtggtttaaagtatattcattctgcagatgtcttgcatcgtgatttgaagcccggcaatttgcttgtcaatgcagattgtcaattgaaaatctgtgattttgggttagctagaggttattcggagaatcctgtcgaaaacagtcaatttttgacggagtacgtggccactagatggtatagagctccggaaataatgttgagttaccaaggatataccaaggcgattgacgtatggtcagctggctgtattttagcggagtttcttggtggaaagccaatcttcaaaggaaaggattacgttaatcaattgaatcaaatattacaagttttagggacacccccagacgaaactttaagaaggattggttctaaaaatgttcaggactacatacatcaattaggtttcattccaaaagtaccttttgtcaatttatacccaaatgccaattcacaagcattagacttattggagcaaatgctcgcgtttgaccctcaaaagagaattaccgtggatgaggccctggagcatccttacttgtctatatggcatgatccagctgacgaacctgtgtgtagtgaaaaattcgaatttagttttgaatcggttaatgatatggaggacttaaaacaaatggttatacaagaagtgcaagatttcaggctgtttgtgagacaaccgctattagaagagcaaaggcaattacaattacagcagcagcaacagcagcagcaacagcaacagcaacagcaacagcagccttcagatgtggataatggcaacgccgcagcgagtgaagaaaattatccaaaacagatggccacgtctaattctgttgcgccacaacaagaatcatttggtattcactcccaaaatttgccaaggcatgatgcagatttcccacctcgacctcaagagagtatgatggagatgagacctgccactggaaataccgcagatattccgcctcagaatgataacggcacgcttctagaccttgaaaaagagctggagtttggattagatagaaaatatttttag

SEQ ID NO: 419 - protein, 484 aa, Saccharomyces cerevisiae
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 420 - DNA, 1302 bp, Saccharomyces cerevisiae
atggcgactgacaccgagaggtgtattttccgtgcattcggccaagattttatcctaaataaacattttcatttgacaggtaagattggtcggggctcacacagccttatttgttcttcaacttacacagaatcgaacgaggaaactcacgtggctatcagaaaaataccaaacgcgtttggcaataaactatcttgcaagagaactcttcgtgaattgaaactactaagacatttaagagggcacccaaatatagtgtggctcttcgatactgatatagtattttacccaaatggggcactaaatggcgtttatttatatgaagaactaatggaatgtgacctttctcaaattataaggtccgaacaacgcctggaagacgcacactttcaaagcttcatatatcagatactgtgtgctctgaaatacatacattctgctaatgttttacattgtgacctgaaaccaaaaaacttacttgttaatagtgattgccaactaaaaatttgtaattttgggctatcgtgtagttattcagaaaaccacaaggttaacgacggcttcattaagggttatataacctcgatatggtataaagcaccagaaattttgctgaattatcaagaatgcacaaaagctgtcgatatttggtcaacaggctgtatcttggccgaactacttggtaggaaaccaatgtttgaagggaaggattatgtagatcatttgaatcatattctacaaatacttggaacaccacctgaggaaacattgcaggaaattgcctctcaaaaggtgtataattatatctttcagttcggtaatatcccgggaagatcgtttgaaagcatactacctggtgctaatccagaagcgcttgaattgctaaagaaaatgctagaatttgatcctaaaaaaaggattactgtagaggatgcactagagcatccatatttgtcaatgtggcatgatatagatgaggaattctcatgtcaaaagacctttagattcgaattcgagcatatcgaaagtatggcggaattaggaaacgaagttataaaggaagtatttgatttcaggaaagttgttagaaaacatcctattagcggtgattccccatcatcatcactatctttagaggatgccattcctcaagaagttgtacaggtccatccttctaggaaagttttacccagttatagtcctgaattttcctatgtaagccaacttccatcactaactacaacccagccatatcaaaaccttatgggaataagctctaattcatttcagggtgttaactaa

SEQ ID NO: 421 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 422 - DNA, 5631 bp, Saccharomyces cerevisiae
atgaacactgatcaacaaccttatcagggccaaacggactatacccagggaccaggtaacgggcaaagtcaggaacaagactatgaccaatatggccagcctttgtatccttcacaagctgatggttactacgatccaaatgtcgctgctggtactgaagctgatatgtatggtcaacaaccaccaaacgagtcttacgaccaagactacacaaacggtgaatactatggtcaaccgccaaatatggctgctcaagacggtgaaaacttctcggattttagcagttacggccctcctggaacacctggatatgatagctatggtggtcagtataccgcttctcaaatgagttatggagaaccaaattcgtcgggtacctcgactccaatttacggtaattatgacccaaatgctatcgctatggctttgccaaatgaaccttatcccgcttggactgctgactctcaatctcccgtttcgatcgagcaaatcgaagatatctttattgatttgaccaacagactcgggttccaaagagactccatgagaaatatgtttgatcattttatggttctcttggactctaggtcctcgagaatgtctcctgatcaagctttactatctttacatgccgactacattggtggcgatactgctaactataaaaaatggtattttgctgctcagttagatatggatgatgaaattggttttagaaatatgagtcttggaaaactctcaaggaaggcaagaaaagctaagaagaaaaacaagaaagcaatggaagaggccaatcccgaagacactgaagaaactttaaacaaaattgaaggcgacaactccctagaggctgctgattttagatggaaggccaagatgaaccagttgtctcccctggaaagagttcgtcatatcgccttatatctgttatgttggggtgaagctaatcaagtcagattcactgctgaatgtttatgttttatctacaagtgtgctcttgactacttggattcccctctttgccaacaacgccaagaacctatgccagaaggtgatttcttgaatagagtcattacgccaatttatcatttcatcagaaatcaagtttatgaaattgttgatggtcgttttgtcaagcgtgaaagagatcataacaaaattgtcggttatgatgatttaaaccaattgttctggtatccagaaggtattgcaaagattgttcttgaagatggaacaaaattgatagaactcccattggaagaacgttatttaagattaggcgatgtcgtctgggatgatgtattcttcaaaacatataaagagacccgtacttggttacatttggtcaccaacttcaaccgtatttgggttatgcatatctccattttttggatgtactttgcatataattcaccaacattttacactcataactatcaacaattggtcgacaaccaacctttggctgcttacaagtgggcatcttgcgcattaggtggtactgtcgcaagtttgattcaaattgtcgctactttgtgtgaatggtcattcgttccaagaaaatgggctggtgctcaacatctatctcgtagattctggtttttatgcatcatctttggtattaatttgggtcctattatttttgtttttgcttacgacaaagatacagtctactccactgctgcacacgttgttgctgctgttatgttctttgttgcggttgctaccatcatattcttctccattatgccattgggggggttgtttacgtcatatatgaaaaaatctacaaggcgttatgttgcatctcaaacattcactgctgcatttgcccctctacatgggttagatagatggatgtcctatttagtttgggttactgtttttgctgccaaatattcagaatcgtactactttttagttttatctttgagagatccaattagaattttgtccaccactgcaatgaggtgtacaggtgaatactggtggggtgcggtactttgtaaagtgcaacccaagattgtcttaggtttggttatcgctaccgacttcattcttttcttcttggatacctacttatggtacattattgtgaataccattttctctgttgggaaatctttctatttaggtatttctatcttaacaccatggagaaatatcttcacaagattgccaaaaagaatatactccaagattttggctactactgatatggaaattaaatacaaaccaaaggttttgatttctcaagtatggaatgccatcattatttcaatgtacagagaacatctcttagccatcgaccatgtacaaaaattactatatcatcaagttccatctgaaatcgaaggtaaaagaactttgagagctcctaccttctttgtttctcaagatgacaataattttgagactgaatttttccctagggattcagaggctgagcgtcgtatttctttctttgctcaatctttgtctactccaattcccgaaccacttccagttgataacatgccaacgttcacagtattgactcctcactacgcggaaagaattctgctgtcattaagagaaattattcgtgaagatgaccaattttctagagttactcttttagaatatctaaaacaattacatcccgttgaatgggaatgttttgttaaggatactaagattttggctgaagaaaccgctgcctatgaaggaaatgaaaatgaagctgaaaaggaagatgctttgaaatctcaaatcgatgatttgccattttattgtattggttttaaatctgctgctccagaatatacacttcgtacgagaatttgggcttctttgaggtcgcagactctatatcgtaccatttcagggttcatgaattattcaagagctatcaaattactgtatcgtgtggaaaatcctgaaattgttcaaatgtttggtggtaatgctgaaggcttagaaagagagctagaaaagatggcaagaagaaagtttaaatttttggtctctatgcagagattggctaaattcaaaccacatgaactggaaaatgctgagtttttgttgagagcttacccagacttacaaattgcctacttggatgaagagccacctttgactgaaggtgaggagccaagaatctattccgctttgattgatggacattgtgaaattctagataatggtcgtagacgtcccaagtttagagttcaattatctggtaacccaattcttggtgacggtaaatctgataaccaaaaccatgctttgattttttacagaggtgaatacattcaattaattgatgccaaccaagataactacttggaagaatgtctgaagattagatctgtattggctgaatttgaggaattgaacgttgaacaagttaatccatatgctcccggtttaaggtatgaggagcaaacaactaatcatcctgttgctattgttggtgccagagaatacattttctctgaaaactctggtgtgctgggtgatgtggccgctggtaaagaacaaacttttggtacattatttgcgcgtactttatctcaaattggtggtaaattgcattatggtcatccggatttcattaatgctacgtttatgaccactagaggtggtgtttccaaagcacaaaagggtttgcatttaaacgaagatatttatgctggtatgaatgctatgcttcgtggtggtcgtatcaagcattgtgagtattatcaatgtggtaaaggtagagatttgggtttcggtacaattctaaatttcactactaagattggtgctggtatgggtgaacaaatgttatctcgtgaatattattatctgggtacccaattaccagtggaccgtttcctaacattctattatgcccatcctggtttccatttgaacaacttgttcattcaattatctttgcaaatgtttatgttgactttggtgaatttatcttccttggcccatgaatctattatgtgtatttacgataggaacaaaccaaaaacagatgttttggttccaattgggtgttacaacttccaacctgcggttgattgggtgagacgttatacattgtctattttcattgttttctggattgccttcgttcctattgttgttcaagaactaattgaacgtggtctatggaaagccacccaaagatttttctgccacctattatcattatcccctatgttcgaagtgtttgcgggccaaatctactcttctgcgttattaagtgatttagcaattggtggtgctcgttatatatccaccggtcgtggttttgcaacttctcgtataccattttcaattttgtattcaagatttgcaggatctgctatctacatgggtgcaagatcaatgttaatgttgctgttcggtactgtcgcacattggcaagctccactactgtggttttgggcctctctatcttcattaatttttgcgcctttcgttttcaatccacatcagtttgcttgggaagatttctttttggattacagggattatatcagatggttatcaagaggtaataatcaatatcatagaaactcgtggattggttacgtgaggatgtctagggcacgtattactgggtttaaacgtaaactggttggcgatgaatctgagaaagctgctggtgacgcaagcagggctcatagaaccaatttgatcatggctgaaatcataccctgtgcaatttatgcagctggttgttttattgccttcacgtttattaatgctcaaaccggtgtcaagactactgatgatgatagggtgaattctgttttacgtatcatcatttgtaccttggcgccaatcgccgttaacctcggtgttctattcttctgtatgggtatgtcatgctgctctggtcccttatttggtatgtgttgtaagaagacaggttctgtaatggctggaattgcccacggtgttgctgttattgtccacattgcctttttcattgtcatgtgggttttggagagcttcaactttgttagaatgttaatcggagtcgttacttgtatccaatgtcaaagactcatttttcattgcatgacagcgttaatgttgactcgtgaatttaaaaacgatcatgccaatacagccttctggactggtaagtggtatggtaaaggtatgggttacatggcttggacccagccaagtagagaattaaccgccaaggtaattgagctttcagaatttgcagctgattttgttctaggtcatgtgattttaatctgtcaactgccactcattataatcccaaaaatagataaattccactcgattatgctattctggctaaagccctctcgtcaaattcgtcccccaatttactctctgaagcaaactcgtttgcgtaagcgtatggtcaagaagtactgctctttgtactttttagtattggctatttttgcaggatgcattattggtcctgctgtagcctctgctaagatccacaaacacattggagattcattggatggcgttgttcacaatctattccaaccaataaatacaaccaataatgacactggttcccaaatgtcaacttatcaaagtcactactatactcatacgccatcattaaagacctggtcaactataaaataa

SEQ ID NO: 423 - protein, 1876 aa, Saccharomyces cerevisiae
MNTDQQPYQGQTDYTQGPGNGQSQEQDYDQYGQPLYPSQADGYYDPNVAAGTEADMYGQQPPNESYDQDYTNGEYYGQPPNMAAQDGENFSDFSSYGPPGTPGYDSYGGQYTASQMSYGEPNSSGTSTPIYGNYDPNAIAMALPNEPYPAWTADSQSPVSIEQIEDIFIDLTNRLGFQRDSMRNMFDHFMVLLDSRSSRMSPDQALLSLHADYIGGDTANYKKWYFAAQLDMDDEIGFRNMSLGKLSRKARKAKKKNKKAMEEANPEDTEETLNKIEGDNSLEAADFRWKAKMNQLSPLERVRHIALYLLCWGEANQVRFTAECLCFIYKCALDYLDSPLCQQRQEPMPEGDFLNRVITPIYHFIRNQVYEIVDGRFVKRERDHNKIVGYDDLNQLFWYPEGIAKIVLEDGTKLIELPLEERYLRLGDVVWDDVFFKTYKETRTWLHLVTNFNRIWVMHISIFWMYFAYNSPTFYTHNYQQLVDNQPLAAYKWASCALGGTVASLIQIVATLCEWSFVPRKWAGAQHLSRRFWFLCIIFGINLGPIIFVFAYDKDTVYSTAAHVVAAVMFFVAVATIIFFSIMPLGGLFTSYMKKSTRRYVASQTFTAAFAPLHGLDRWMSYLVWVTVFAAKYSESYYFLVLSLRDPIRILSTTAMRCTGEYWWGAVLCKVQPKIVLGLVIATDFILFFLDTYLWYIIVNTIFSVGKSFYLGISILTPWRNIFTRLPKRIYSKILATTDMEIKYKPKVLISQVWNAIIISMYREHLLAIDHVQKLLYHQVPSEIEGKRTLRAPTFFVSQDDNNFETEFFPRDSEAERRISFFAQSLSTPIPEPLPVDNMPTFTVLTPHYAERILLSLREIIREDDQFSRVTLLEYLKQLHPVEWECFVKDTKILAEETAAYEGNENEAEKEDALKSQIDDLPFYCIGFKSAAPEYTLRTRIWASLRSQTLYRTISGFMNYSRAIKLLYRVENPEIVQMFGGNAEGLERELEKMARRKFKFLVSMQRLAKFKPHELENAEFLLRAYPDLQIAYLDEEPPLTEGEEPRIYSALIDGHCEILDNGRRRPKFRVQLSGNPILGDGKSDNQNHALIFYRGEYIQLIDANQDNYLEECLKIRSVLAEFEELNVEQVNPYAPGLRYEEQTTNHPVAIVGAREYIFSENSGVLGDVAAGKEQTFGTLFARTLSQIGGKLHYGHPDFINATFMTTRGGVSKAQKGLHLNEDIYAGMNAMLRGGRIKHCEYYQCGKGRDLGFGTILNFTTKIGAGMGEQMLSREYYYLGTQLPVDRFLTFYYAHPGFHLNNLFIQLSLQMFMLTLVNLSSLAHESIMCIYDRNKPKTDVLVPIGCYNFQPAVDWVRRYTLSIFIVFWIAFVPIVVQELIERGLWKATQRFFCHLLSLSPMFEVFAGQIYSSALLSDLAIGGARYISTGRGFATSRIPFSILYSRFAGSAIYMGARSMLMLLFGTVAHWQAPLLWFWASLSSLIFAPFVFNPHQFAWEDFFLDYRDYIRWLSRGNNQYHRNSWIGYVRMSRARITGFKRKLVGDESEKAAGDASRAHRTNLIMAEIIPCAIYAAGCFIAFTFINAQTGVKTTDDDRVNSVLRIIICTLAPIAVNLGVLFFCMGMSCCSGPLFGMCCKKTGSVMAGIAHGVAVIVHIAFFIVMWVLESFNFVRMLIGVVTCIQCQRLIFHCMTALMLTREFKNDHANTAFWTGKWYGKGMGYMAWTQPSRELTAKVIELSEFAADFVLGHVILICQLPLIIIPKIDKFHSIMLFWLKPSRQIRPPIYSLKQTRLRKRMVKKYCSLYFLVLAIFAGCIIGPAVASAKIHKHIGDSLDGVVHNLFQPINTTNNDTGSQMSTYQSHYYTHTPSLKTWSTIK

SEQ ID NO: 424 - skipped

SEQ ID NO: 425 - protein, 1895 aa, Saccharomyces cerevisiae
MSYNDPNLNGQYYSNGDGTGDGNYPTYQVTQDQSAYDEYGQPIYTQNQLDDGYYDPNEQYVDGTQFPQGQDPSQDQGPYNNDASYYNQPPNMMNPSSQDGENFSDFSSYGPPSGTYPNDQYTPSQMSYPDQDGSSGASTPYGNGVVNGNGQYYDPNAIEMALPNDPYPAWTADPQSPLPIEQIEDIFIDLTNKFGFQRDSMRNMFDHFMTLLDSRSSRMSPEQALLSLHADYIGGDTANYKKWYFAAQLDMDDEIGFRNMKLGKLSRKARKAKKKNKKAMQEASPEDTEETLNQIEGDNSLEAADFRWKSKMNQLSPFEMVRQIALFLLCWGEANQVRFTPECLCFIYKCASDYLDSAQCQQRPDPLPEGDFLNRVITPLYRFIRSQVYEIVDGRYVKSEKDHNKVIGYDDVNQLFWYPEGIAKIVMEDGTRLIDLPAEERYLKLGEIPWDDVFFKTYKETRSWLHLVTNFNRIWIMHISVYWMYCAYNAPTFYTHNYQQLVDNQPLAAYKWATAALGGTVASLIQVAATLCEWSFVPRKWAGAQHLSRRFWFLCVIMGINLGPVIFVFAYDKDTVYSTAAHVVGAVMFFVAVATLVFFSVMPLGGLFTSYMKKSTRSYVASQTFTASFAPLHGLDRWMSYLVWVTVFAAKYAESYFFLILSLRDPIRILSTTSMRCTGEYWWGNKICKVQPKIVLGLMIATDFILFFLDTYLWYIVVNTVFSVGKSFYLGISILTPWRNIFTRLPKRIYSKILATTDMEIKYKPKVLISQIWNAIIISMYREHLLAIDHVQKLLYHQVPSEIEGKRTLRAPTFFVSQDDNNFETEFFPRDSEAERRISFFAQSLSTPIPEPLPVDNMPTFTVLTPHYAERILLSLREIIREDDQFSRVTLLEYLKQLHPVEWDCFVKDTKILAEETAAYENNEDEPEKEDALKSQIDDLPFYCIGFKSAAPEYTLRTRIWASLRSQTLYRTISGFMNYSRAIKLLYRVENPEIVQMFGGNADGLERELEKMARRKFKFLVSMQRLAKFKPHELENAEFLLRAYPDLQIAYLDEEPPLNEGEEPRIYSALIDGHCEILENGRRRPKFRVQLSGNPILGDGKSDNQNHALIFYRGEYIQLIDANQDNYLEECLKIRSVLAEFEELGIEQIHPYTPGLKYEDQSTNHPVAIVGAREYIFSENSGVLGDVAAGKEQTFGTLFARTLAQIGGKLHYGHPDFINATFMTTRGGVSKAQKGLHLNEDIYAGMNAVLRGGRIKHCEYYQCGKGRDLGFGTILNFTTKIGAGMGEQMLSREYYYLGTQLPIDRFLTFYYAHPGFHLNNLFIQLSLQMFMLTLVNLHALAHESILCVYDRDKPITDVLYPIGCYNFHPAIDWVRRYTLSIFIVFWIAFVPIVVQELIERGLWKATQRFFRHILSLSPMFEVFAGQIYSSALLSDIAVGGARYISTGRGFATSRIPFSILYSRFAGSAIYMGSRSMLMLLFGTVAHWQAPLLWFWASLSALIFAPFIFNPHQFAWEDFFLDYRDYIRWLSRGNNKYHRNSWIGYVRMSRSRVTGFKRKLVGDESEKSAGDASRAHRTNLIMAEIIPCAIYAAGCFIAFTFINAQTGVKTTDEDRVNSTLRIIICTLAPIVIDIGVLFFCMGLSCCSGPLLGMCCKKTGSVMAGIAHGIAVVVHIVFFIVMWVLEGFSFVRMLIGVVTCIQCQRLIFHCMTVLLLTREFKNDHANTAFWTGKWYSTGLGYMAWTQPTRELTAKVIELSEFAADFVLGHVILIFQLPVICIPKIDKFHSIMLFWLKPSRQIRPPIYSLKQARLRKRMVRRYCSLYFLVLIIFAGCIVGPAVASAHVPKDLGSGLTGTFHNLVQPRNVSNNDTGSQMSTYKSHYYTHTPSLKTWSTIK

SEQ ID NO: 426 - DNA, 3498 bp, Saccharomyces cerevisiae
atgaccggcttgaatggagatgatcctgatgactactatctgaaccttaatcaagatgaagagtctctacttaggtcaagacacagtgtcggctcaggagcacctcatagacaaggctctttagtgcggcccgaaagaagccgactgaacaatcctgataatccacatttttattatgcgcagaaaacgcaggagcagatgaatcacctggatgttttaccatcaagtaccggtgtaaacccaaatgcaactcgtcggagtggctccctgcgctccaaaggctcagtgagaagcaaatttagtggccgcgaaacggatagctatcttttacaagatatgaatactactgacaagaaggcttccgttaaaataagtgatgaaggtgttgcggaagacgaatttgataaagatggtgatgtggacaatttcgaagaaagctccacgcagcccataaataagtctatcaaaccattaagaaaggaaacgaatgatacattgtcattttggcagatgtactgttatttcattacgttttgggcacctgctccaattcttgctttctgcgggatgccaaagaaggaaagacaaatggcgtggagagaaaaggttgctttaatttctgtcatcttgtacattggtgcgattgtggctttcctgacttttggtttcactaaaaccgtttgtagtagttcgaaactacgtttgaaaaacaacgaagtatcaacagaatttgtcgtaattaacggtaaggcttatgaattggatacttcctcgcgttccggtatacaagacgttgaagtagattcagacaccctttatgggccctggtcagatgctggtaaagatgcttcgttcttgtttcaaaatgtgaatggtaactgtcataaccttataactccaaagagtaattcttccattccccatgacgatgataataatttagcatggtattttccttgtaagttaaagaatcaagatggctcttcgaagccaaacttcacagttgaaaattacgcaggatggaactgtcatacgtctaaagaagatagggacgcattttacggtttaaagtcgaaagctgatgtttacttcacttgggatggtataaagaactcttctagaaacttgattgtttataatggcgacgttttggatttagatcttcttgattggttggaaaaggatgacgttgactatcccgttgtattcgatgacttgaagacttcaaatttacaaggttatgatctttcgttggttttgtcaaatgggcatgaaagaaaaattgcgagatgtttgagcgaaattattaaagttggtgaagtagactccaaaaccgtcggttgtattgcctctgatgtcgttttgtatgtttctctggtatttattctttcagtggtgataattaaattcataattgcctgctacttccgttggactgtagctaggaaacaaggtgcatatatcgtggacaataaaacaatggataaacacacaaacgatatcgaggattggtctaataatattcaaacaaaagctcctctaaaggaagtagatcctcatttgaggccaaagaaatactcaaaaaagtcgttgggacacaagcgtgcttcaacctttgacttgctgaaaaaacacagctccaaaatgtttcaatttaacgaatctgtgatagatctagacacctccatgagcagttcactacaatcttctggttcatacagaggaatgacaacaatgaccactcaaaatgcttggaaactctcgaatgaaaacaaagctgtacattcccgtaatccatctactttgttgcctacatcctcgatgttttggaataaagcgacttcctctcctgtaccaggatcatcgctgattcagagtcttgattcgacgattatacatcccgatatcgttcaacaaccaccactggattttatgccatacgggttcccattgattcatactatctgttttgttacttgttattctgaggatgaagagggtttaagaaccactttagactctctttctaccacagattatccaaattcccataaactactgatggttgtttgtgatggtttaattaagggctcgggcaacgataagactactccagagatagcgttaggaatgatggacgactttgtcaccccacctgatgaagttaaaccttactcctatgtggcagtggcatcaggctctaaaagacacaatatggccaagatatatgcgggtttttacaaatatgacgattctacaattccaccagaaaatcaacaacgtgtcccaatcattacaattgtgaagtgcggtactcctgcagagcagggggccgccaaacccggtaacagaggtaagcgtgattctcaaattattctgatgtcctttttagaaaaaataacatttgatgaaagaatgactcaattggaatttcagcttttaaaaaatatttggcagattacggggctaatggcagacttctacgaaacggtacttatggttgatgctgatactaaagtctttcccgatgctttaactcatatggtcgctgaaatggttaaagatcctttgattatgggtctttgtggtgagaccaagatcgctaataaggcacaatcttgggtaactgcaattcaagtgtttgagtactatatttcgcatcatcaggctaaagcttttgaatctgtcttcggttcggtaacttgtttgccgggatgtttctcaatgtatcgtataaaatctcctaaaggttcagatggttattgggtacctgtattggcaaatccagatattgttgaaagatattcggataatgttacaaacactttgcataagaagaacttattattacttggtgaagatagatttttatcttcattaatgttaaagactttccctaagagaaagcaagtatttgttccaaaagctgcttgtaaaactattgcccctgataaattcaaagtcttactttcccagcgtcgaagatggattaattctacggtacataacctttttgaattagttctaatcagagacttatgtggcactttctgtttttccatgcaatttgtgattggtattgaattgattggtactatggtactgccgttagccatttgctttactatttatgtcattatttttgccattgtatcaaaacctacacccgtaatcactttagttttactggcaattattcttggtctgcccggcttaattgttgttataactgctacgagatggtcgtacctatggtggatgtgcgtatatatttgtgctttgcctatttggaatttcgtactaccttcatatgcgtactggaaatttgatgacttctcatggggtgatacgagaactattgcgggaggtaataaaaaggcacaagacgagaatgaaggtgaatttgatcactcaaagattaaaatgaggacatggagggaatttgaaagggaagatattctcaatcggaaggaggaaagtgactccttcgttgcatag

SEQ ID NO: 427 - protein, 1165 aa, Saccharomyces cerevisiae
MTGLNGDDPDDYYLNLNQDEESLLRSRHSVGSGAPHRQGSLVRPERSRLNNPDNPHFYYAQKTQEQMNHLDVLPSSTGVNPNATRRSGSLRSKGSVRSKFSGRETDSYLLQDMNTTDKKASVKISDEGVAEDEFDKDGDVDNFEESSTQPINKSIKPLRKETNDTLSFWQMYCYFITFWAPAPILAFCGMPKKERQMAWREKVALISVILYIGAIVAFLTFGFTKTVCSSSKLRLKNNEVSTEFVVINGKAYELDTSSRSGIQDVEVDSDTLYGPWSDAGKDASFLFQNVNGNCHNLITPKSNSSIPHDDDNNLAWYFPCKLKNQDGSSKPNFTVENYAGWNCHTSKEDRDAFYGLKSKADVYFTWDGIKNSSRNLIVYNGDVLDLDLLDWLEKDDVDYPVVFDDLKTSNLQGYDLSLVLSNGHERKIARCLSEIIKVGEVDSKTVGCIASDVVLYVSLVFILSVVIIKFIIACYFRWTVARKQGAYIVDNKTMDKHTNDIEDWSNNIQTKAPLKEVDPHLRPKKYSKKSLGHKRASTFDLLKKHSSKMFQFNESVIDLDTSMSSSLQSSGSYRGMTTMTTQNAWKLSNENKAVHSRNPSTLLPTSSMFWNKATSSPVPGSSLIQSLDSTIIHPDIVQQPPLDFMPYGFPLIHTICFVTCYSEDEEGLRTTLDSLSTTDYPNSHKLLMVVCDGLIKGSGNDKTTPEIALGMMDDFVTPPDEVKPYSYVAVASGSKRHNMAKIYAGFYKYDDSTIPPENQQRVPIITIVKCGTPAEQGAAKPGNRGKRDSQIILMSFLEKITFDERMTQLEFQLLKNIWQITGLMADFYETVLMVDADTKVFPDALTHMVAEMVKDPLIMGLCGETKIANKAQSWVTAIQVFEYYISHHQAKAFESVFGSVTCLPGCFSMYRIKSPKGSDGYWVPVLANPDIVERYSDNVTNTLHKKNLLLLGEDRFLSSLMLKTFPKRKQVFVPKAACKTIAPDKFKVLLSQRRRWINSTVHNLFELVLIRDLCGTFCFSMQFVIGIELIGTMVLPLAICFTIYVIIFAIVSKPTPVITLVLLAIILGLPGLIVVITATRWSYLWWMCVYICALPIWNFVLPSYAYWKFDDFSWGDTRTIAGGNKKAQDENEGEFDHSKIKMRTWREFEREDILNRKEESDSFVA

SEQ ID NO: 428 - DNA, 891 bp, Saccharomyces cerevisiae
atggattactttaatatcaagcagaattactacacggggaacttcgtgcaatgtttgcaggaaatagagaagtttagcaaggtcacagataacaccttattattctacaaggcgaaaacccttttagctctaggccaatatcaatcacaagatcctacctctaagcttggcaaggtactagacttgtacgtccagttcttagatacaaaaaacattgaagaattagaaaatttgttaaaggataaacagaattcaccatatgaattatatctgttagccacggctcaagctatcttgggtgacttagataaaagtttggagacatgtgtagaagggattgacaatgacgaagcagaagggactacagaattattgctgcttgccatcgaagtcgctttgttaaacaacaacgtttcgaccgcgtccaccatctttgataactacactaatgctattgaggatactgtttccggtgacaacgaaatgattttaaacctggctgaatcgtacattaaatttgccacaaacaaagaaacggcaacatccaacttttactactatgaagagctatctcaaacctttcctacttggaaaactcaattgggattgctcaatttgcatttacagcaaagaaacatagctgaagctcagggtattgtcgagctattactatctgactactatagcgtcgaacaaaaagaaaacgccgtattgtacaaacctactttcttagcaaaccaaattacgcttgctcttatgcaaggtcttgatactgaagatttaacaaatcaattggttaaattggatcacgaacatgcattcatcaagcatcaccaagaaattgacgcaaaattcgatgaattagtgaggaaatatgatacgtccaactga

SEQ ID NO: 429 - protein, 296 aa, Saccharomyces cerevisiae
MDYFNIKQNYYTGNFVQCLQEIEKFSKVTDNTLLFYKAKTLLALGQYQSQDPTSKLGKVLDLYVQFLDTKNIEELENLLKDKQNSPYELYLLATAQAILGDLDKSLETCVEGIDNDEAEGTTELLLLAIEVALLNNNVSTASTIFDNYTNAIEDTVSGDNEMILNLAESYIKFATNKETATSNFYYYEELSQTFPTWKTQLGLLNLHLQQRNIAEAQGIVELLLSDYYSVEQKENAVLYKPTFLANQITLALMQGLDTEDLTNQLVKLDHEHAFIKHHQEIDAKFDELVRKYDTSN

SEQ ID NO: 430 - DNA, 1377 bp, Saccharomyces cerevisiae
atgatcgtcaatattagtgcgaagatgatcttatcgatatgctttacgtttctgtcattttttaaagccactcatgccatggatttggatactactagcaaaacgtcaatttgtgatgcgacagcgttaattcaaggtggtatgctggattactatgagggtactagatacggtggtaccgttgggatgtttcagtcaccatactattggtggcatgcaggggaagcatttggtggcatgttggaaaattggtttctttgtgagaatgatacatatcaagaattactatacgatgcactattagcgcaaactggttccaattacgattatatcccgtccaaccaaacgatggttgaggggaatgatgaccaaggtatttggggtattactgttatgggtgctgtcgagagaaattttacagaccccggtgacggcaagccaggttggttggcaatggtacaagctgttttcaacaccatgtactcaagatgggattcagagcactgtggcggtggtctgagatggcaaattttcacttggaatagtggttataattataaaaatacagtttcaaatgcatgtttgttccagattgcggcgaggttgggcagatatactggtaacactacatatttggaggttgctgaacaggttttcgactggctagtggatgtcgggtatgtggttcttaacgatactgcaaatgtctttgatggtgctgaaattgatacaaattgcactgatattacaaaaattgaatggacttataatcacggtatcgtgcttggtggtcttgcatacatgtataatgctacaaatggaacaggtgaatgggagaccagtttgacaaaaattctaaatggtgctaaatcttatttcttcaaagatagtattatgtacgaaagcgcttgtcaagactatggcacctgtaacaccgatcaaagaacattcaaaagtattttttctcgtatgcttggtcttacaagtgtcatggctccctttactagggacacaattgatgatttgataaaaacaagtgctgaggccgctgcaaaatcatgtaatggtggtacagatgggcatacatgtggtttaaattggcagaaacaaaccaatgatggctactatggattaggtgagcaaatgagtgctctagaagttattcaaaatcttttaattcatgacaggccagctccatataaggaagataatggcggtacgtcaaaaggtgacgcgaatgccggtatgaactcatcgaccactaacgtgctacaaaacaatttaaacattaagaaaggtgatcgcgctggtgccgctatcatcacagcagtcatactgagtgtgctaactggtggggctgtgtggatgctgttttaa

SEQ ID NO: 431 - protein, 458 aa, Saccharomyces cerevisiae
MIVNISAKMILSICFTFLSFFKATHAMDLDTTSKTSICDATALIQGGMLDYYEGTRYGGTVGMFQSPYYWWHAGEAFGGMLENWFLCENDTYQELLYDALLAQTGSNYDYIPSNQTMVEGNDDQGIWGITVMGAVERNFTDPGDGKPGWLAMVQAVFNTMYSRWDSEHCGGGLRWQIFTWNSGYNYKNTVSNACLFQIAARLGRYTGNTTYLEVAEQVFDWLVDVGYVVLNDTANVFDGAEIDTNCTDITKIEWTYNHGIVLGGLAYMYNATNGTGEWETSLTKILNGAKSYFFKDSIMYESACQDYGTCNTDQRTFKSIFSRMLGLTSVMAPFTRDTIDDLIKTSAEAAAKSCNGGTDGHTCGLNWQKQTNDGYYGLGEQMSALEVIQNLLIHDRPAPYKEDNGGTSKGDANAGMNSSTTNVLQNNLNIKKGDRAGAAIITAVILSVLTGGAVWMLF

SEQ ID NO: 432 - DNA, 957 bp, Saccharomyces cerevisiae
atgacagtaatcaccattgccaagagaggccttccaaaattaaccacttccacttcttcgacaacaactgccagttcaagtagtacgataacatctgttgcttcttcttcatcttctttaccacttttgtccaactctacatcctcttctattataccaagtattactcctccctctagaaatggtaatccttatattttggattccggggatatgcctaatggaacagttttcattgtagtggggggaatcgcgggagtgatttttttggcaatattgctatggtgggtaataacaacttattcttcgcataggttgaccagaagtgttcaggactacgaatcaaagatgttttccacacaacatacccagttttacggcgattccccatatatggattatcccgccaaagaaaatttccaagatcaggtccatatcagcgagtccgatattagtcccggaaataaggatgaatcggtgaaagatgcacttgtatctcatactaataatgaaaaaccattcttaagtaatttcgaaaggccgctattctctcttgcatccgaatccaacagaaattcacttttcatttcaccaacaggtgatatcttatacaaaacaaggctatctaaactttaccaagaaagccctagattattacagaaacctgtgattatgacaagtgataatgtatctacaaattctctggtgtctacaatctcttcatcatccgcatcgtcgctcgataacggtaatgaaaaggaggtgggtgaagacataaggaaacccgcaaaaattgcatcttcaccaagtcgaaagctgcttaattcaccagaaagtgatggtagcgtaaatcgtaaccatagtaagggtaatttgttggtcgtacagtccaaaagaaaacctacaccttcgacttatctcgagcacatgctggaggggaaagaacaggatgagtaa

SEQ ID NO: 433 - protein, 318 aa, Saccharomyces cerevisiae
MTVITIAKRGLPKLTTSTSSTTTASSSSTITSVASSSSSLPLLSNSTSSSIIPSITPPSRNGNPYILDSGDMPNGTVFIVVGGIAGVIFLAILLWWVITTYSSHRLTRSVQDYESKMFSTQHTQFYGDSPYMDYPAKENFQDQVHISESDISPGNKDESVKDALVSHTNNEKPFLSNFERPLFSLASESNRNSLFISPTGDILYKTRLSKLYQESPRLLQKPVIMTSDNVSTNSLVSTISSSSASSLDNGNEKEVGEDIRKPAKIASSPSRKLLNSPESDGSVNRNHSKGNLLVVQSKRKPTPSTYLEHMLEGKEQDE

SEQ ID NO: 434 - DNA, 951 bp, Saccharomyces cerevisiae
atggttaagaaaaactttatcccgtctgtatcgctggtcagaagagaccttcctactttagttactactacaactagttcaaccgccctgtcaaagcccacgtcaagtgtagtgtccgaaacgagttccaagtcccttccatcgttaacatcttcggctttctcaacttccagtggagcaacatcctcctcatcactaattgtcgcaagtataacacccccatctacagcaggaaacccatttattttaaatgctgctgataaaccaaatggaactgtatacattgctgtgggtgctgtcataggtgccatttttatcagtattcttatatggtggttagtgtccagttatttgtctcgtcgtttcacaatgacaaattcttatgcaaatgatagtaaaaatttgtacaggggacaccacaagcatagttcttctttacaaagcaatccctttgacatcaatgatgagaaatcatatatgcaggatgattgggattctatgagccaattagaatctagccaatacgaggatgctgcctcaccattcaacccaattcaggatccgttcacagacaacagaagatccttatttatatctcctactttacaagtgtcacaatatgaaaaaagtcatagccgccatcaatcaaaagacactaacatttttattgacgatccatttttatacgtaggtacctatctagaagaagaagaagaagaagaagaagagagaaagctgaacctcaatagaccacaaagagcagcgtcacctgaaagaaaggaaaagaaaattaactcaatggaaggctaccataagagaaaccaatcctccttgggcctcataccagtcgcttctgctacctcaaatactagctctcctaaaaaggctcataaaagacaggcgccatcgatgtttttggatgatgtcctgaatggtagagaaataatctag

SEQ ID NO: 435 - protein, 316 aa, Saccharomyces cerevisiae
MVKKNFIPSVSLVRRDLPTLVTTTTSSTALSKPTSSVVSETSSKSLPSLTSSAFSTSSGATSSSSLIVASITPPSTAGNPFILNAADKPNGTVYIAVGAVIGAIFISILIWWLVSSYLSRRFTMTNSYANDSKNLYRGHHKHSSSLQSNPFDINDEKSYMQDDWDSMSQLESSQYEDAASPFNPIQDPFTDNRRSLFISPTLQVSQYEKSHSRHQSKDTNIFIDDPFLYVGTYLEEEEEEEEERKLNLNRPQRAASPERKEKKINSMEGYHKRNQSSLGLIPVASATSNTSSPKKAHKRQAPSMFLDDVLNGREII

SEQ ID NO: 436 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggaaagccttaccattcaaatgccaaaggtgatttggcacaaattttacagcttaccagatattttgctgggtccgctgataagtttgacaaaggtgcaaccataccattgacttttaacaagtttgcatatactctaaaagttccttttggcgttgttgctcaaatcgttccatggaattatcctctagctatggcttgttggaaattgcaaggtgccttagcagccggtaacacggttatcatcaaacctgctgagaatacctctctatctctactttattttgctactttaattaaaaaagcaggttttccacctggtgttgtcaatatcgttcctggttatggatcacttgtaggccaagccctagcatctcacatggatatcgacaaaatatcttttacgggaagcaccaaggtcggtggatttgtgttggaagcttccggccaatcgaaccttaaagacgttacactagaatgcggtggtaagtctcctgctctcgtatttgaagatgcagaccttgataaggctatcgattggatagcagctggcattttctacaattcaggacagaattgtaccgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaagggaggaaaagttggacatgttccagacctctgaatttcctattggtggagctaaaggctacttcattcccccaaccatcttcactgatgtcccgcaaacatcgaaactgttacaggatgagatatttggcccggttgtggttgttagcaagttcacaaattatgatgacgctctgaagctggctaatgatacttgctacgggctcgcctctgcggtcttcacaaaagatgtcaagaaagcgcacatgtttgctcgcgatattaaagcaggaactgtttggatcaactcatctaacgatgaagatgttaccgttccttttggcgggtttaaaatgagtggtattggtagagaactggggcaaagtggtgttgatacctatcttcaaacaaaagcagttcacataaatctctctttggacaactaa

SEQ ID NO: 437 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 438 - DNA, 1521 bp, Saccharomyces cerevisiae
atgcctaccttgtatactgatatcgaaatcccacaattgaaaatctctttaaagcaaccgctagggttgtttatcaacaatgagttttgtccatcatcagatggaaagaccatcgaaactgtgaacccagctactggcgaaccgataacatccttccaagcagctaacgaaaaggatgtagacaaagctgtgaaagctgccagggctgcttttgataacgtttggtcgaagacatcttctgagcaacgtggtatttatctttcaaacttattaaaacttattgaggaggagcaagacacacttgccgcattagagactttagacgctggtaagcctttccattccaatgctaaacaagacttagcccagattatagaacttacaagatactatgcgggggcggtcgacaagttcaatatgggtgaaaccattccattgacttttaacaagtttgcatatactctaaaagttccttttggcgttgttgctcaaatcgttccatggaattatcctctagctatggcttgtagaaaaatgcaaggtgccttagcggccggtaacacggttatcatcaaacctgctgaaaatacctctctatctctactttattttgctactttaattaaaaaagcaggttttccacctggtgttgtcaatgtcattcctggttatggttccgttgtggggaaagctttaggaacccacatggatatcgacaaaatatcttttacgggaagtactaaggttggcggctcagtattggaagcttccggccaatcgaaccttaaggatatcacactagaatgcggtggtaagtctcctgctcttgtatttgaagatgcagaccttgataaggctatagaatgggtagcaaatggtattttttttaattcgggacagatctgcactgcaaactcaagagtttatgttcaaagttcgatctacgacaagtttgttgaaaagtttaaagaaactgcaaagaaggagtgggatgttgcaggaaaatttgatccgtttgatgagaaatgcatcgttggtccagttatatcaagtacacagtatgaccgcatcaaaagttacatagaacgtggtaaaaaggaggaaaagttggacatgttccagacctctgaatttcctattggtggagctaaaggctacttcattcccccaaccatcttcactgatgtaccagaaacatctaagttgctgcgtgatgaaatatttggcccggttgtggttgttagcaagttcacaaattatgatgacgctctgaagctggctaatgatacttgctacgggctcgcctctgcggtcttcaccaaagatgtcaagaaagcgcacatgtttgctcgcgatattaaagcaggaactgtttggatcaatcaaaccaatcaagaagaagctaaagttccttttggcggatttaagatgagtggtattggtagagaatcaggcgacaccggcgttgataactatttacaaataaaatcagtccatgtggatctttcattggataaataa

SEQ ID NO: 439 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 440 - DNA, 1560 bp, Saccharomyces cerevisiae
atgttcagtagatctacgctctgcttaaagacgtctgcatcctccattgggagacttcaattgagatatttctcacaccttcctatgacagtgcctatcaagctgcccaatgggttggaatatgagcaaccaacggggttgttcatcaacaacaagtttgttccttctaaacagaacaagaccttcgaagtcattaacccttccacggaagaagaaatatgtcatatttatgaaggtagagaggacgatgtggaagaggccgtgcaggccgccgaccgtgccttctctaatgggtcttggaacggtatcgaccctattgacaggggtaaggctttgtacaggttagccgaattaattgaacaggacaaggatgtcattgcttccatcgagactttggataacggtaaagctatctcttcctcgagaggagatgttgatttagtcatcaactatttgaaatcttctgctggctttgctgataaaattgatggtagaatgattgatactggtagaacccatttttcttacactaagagacagcctttgggtgtttgtgggcagattattccttggaatttcccactgttgatgtgggcctggaagattgcccctgctttggtcaccggtaacaccgtcgtgttgaagactgccgaatccaccccattgtccgctttgtatgtgtctaaatacatcccacaggcgggtattccacctggtgtgatcaacattgtatccgggtttggtaagattgtgggtgaggccattacaaaccatccaaaaatcaaaaaggttgccttcacagggtccacggctacgggtagacacatttaccagtccgcagccgcaggcttgaaaaaagtgactttggagctgggtggtaaatcaccaaacattgtcttcgcggacgccgagttgaaaaaagccgtgcaaaacattatccttggtatctactacaattctggtgaggtctgttgtgcgggttcaagggtgtatgttgaagaatctatttacgacaaattcattgaagagttcaaagccgcttctgaatccatcaaggtgggcgacccattcgatgaatctactttccaaggtgcacaaacctctcaaatgcaactaaacaaaatcttgaaatacgttgacattggtaagaatgaaggtgctactttgattaccggtggtgaaagattaggtagcaagggttacttcattaagccaactgtctttggtgacgttaaggaagacatgagaattgtcaaagaggaaatctttggccctgttgtcactgtaaccaaattcaaatctgccgacgaagtcattaacatggcgaacgattctgaatacgggttggctgctggtattcacacctctaatattaataccgccttaaaagtggctgatagagttaatgcgggtacggtctggataaacacttataacgatttccaccacgcagttcctttcggtgggttcaatgcatctggtttgggcagggaaatgtctgttgatgctttacaaaactacttgcaagttaaagcggtccgtgccaaattggacgagtaa

SEQ ID NO: 441 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 442 - DNA, 1563 bp, Saccharomyces cerevisiae
atgctttctcgcacaagagctgcagctccgaattccagaatattcactagaagcttgttacgtctttattctcaagcaccattacgcgttccaattactcttccaaatggtttcacctacgaacagccaacagggttattcatcaatggtgaatttgttgcctcgaagcaaaagaaaacgtttgacgtgatcaatccatctaacgaagaaaagataacaactgtatacaaggctatggaagatgatgttgatgaagccgttgcagcggctaaaaaagcttttgaaacgaagtggtctattgtagagccggaggttcgcgctaaagctttattcaatctcgctgacttggttgagaaacaccaagaaacactggctgccattgagtcaatggataatggtaagtcattgttttgtgcgcgcggtgacgtcgctttagtatctaaatacttgcgttcttgcggtggttgggcagataaaatctacggtaacgttattgacacaggtaaaaaccattttacctactcaattaaggaaccattaggcgtttgcggccaaataatcccttggaacttccctttattgatgtggtcatggaaaattgggcctgctctggctacaggtaacaccgtcgtattgaaacccgctgaaacaacacctttatctgcccttttcgcttcccagttgtgtcaggaagcaggcatacccgctggtgtagtcaatatccttccgggttccggtagagttgttggagaaagattgagtgcacacccagacgtgaagaagattgcttttacaggctctactgccaccggccgccatattatgaaggtcgctgccgatactgtcaagaaagtcactttggagctgggaggtaaatcaccaaatattgtgtttgctgacgctgatctagataaagccgtcaagaacattgccttcggtattttttacaactctggtgaagtttgctgcgctggttccagaatatacattcaagatacagtatacgaggaggtgttgcaaaaactaaaggattacaccgagtcactaaaggtcggtgacccatttgatgaggaagttttccaaggtgctcaaacatctgacaaacagctgcataaaattttagactatgtcgatgtagcaaaatcagagggggctcgtcttgtgactggaggggccagacatggcagtaaaggttattttgtcaagccaacagtgtttgctgatgtcaaagaagatatgagaattgttaaggaggaagtgtttggtcccattgtaactgtatccaagttttctactgttgatgaagtgattgctatggcaaatgattctcaatatgggttagccgcaggtattcacactaacgatattaacaaggctgttgatgtgtccaaaagagtgaaagctggtactgtttggataaatacctataacaacttccaccaaaatgttcctttcggtggcttcggccagtcaggtattggccgtgaaatgggtgaggctgctttaagtaactacactcaaacaaaatctgtcagaattgccattgacaagccaattcgttga

SEQ ID NO: 443 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 444 - DNA, 1176 bp, Saccharomyces cerevisiae
atgtctgctgctgctgatagattaaacttaacttccggccacttgaatgctggtagaaagagaagttcctcttctgtttctttgaaggctgccgaaaagcctttcaaggttactgtgattggatctggtaactggggtactactattgccaaggtggttgccgaaaattgtaagggatacccagaagttttcgctccaatagtacaaatgtgggtgttcgaagaagagatcaatggtgaaaaattgactgaaatcataaatactagacatcaaaacgtgaaatacttgcctggcatcactctacccgacaatttggttgctaatccagacttgattgattcagtcaaggatgtcgacatcatcgttttcaacattccacatcaatttttgccccgtatctgtagccaattgaaaggtcatgttgattcacacgtcagagctatctcctgtctaaagggttttgaagttggtgctaaaggtgtccaattgctatcctcttacatcactgaggaactaggtattcaatgtggtgctctatctggtgctaacattgccaccgaagtcgctcaagaacactggtctgaaacaacagttgcttaccacattccaaaggatttcagaggcgagggcaaggacgtcgaccataaggttctaaaggccttgttccacagaccttacttccacgttagtgtcatcgaagatgttgctggtatctccatctgtggtgctttgaagaacgttgttgccttaggttgtggtttcgtcgaaggtctaggctggggtaacaacgcttctgctgccatccaaagagtcggtttgggtgagatcatcagattcggtcaaatgtttttcccagaatctagagaagaaacatactaccaagagtctgctggtgttgctgatttgatcaccacctgcgctggtggtagaaacgtcaaggttgctaggctaatggctacttctggtaaggacgcctgggaatgtgaaaaggagttgttgaatggccaatccgctcaaggtttaattacctgcaaagaagttcacgaatggttggaaacatgtggctctgtcgaagacttcccattatttgaagccgtataccaaatcgtttacaacaactacccaatgaagaacctgccggacatgattgaagaattagatctacatgaagattag

SEQ ID NO: 445 - protein, 391 aa, Saccharomyces cerevisiae
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 446 - DNA, 1323 bp, Saccharomyces cerevisiae
atgcttgctgtcagaagattaacaagatacacattccttaagcgaacgcatccggtgttatatactcgtcgtgcatataaaattttgccttcaagatctactttcctaagaagatcattattacaaacacaactgcactcaaagatgactgctcatactaatatcaaacagcacaaacactgtcatgaggaccatcctatcagaagatcggactctgccgtgtcaattgtacatttgaaacgtgcgcccttcaaggttacagtgattggttctggtaactgggggaccaccatcgccaaagtcattgcggaaaacacagaattgcattcccatatcttcgagccagaggtgagaatgtgggtttttgatgaaaagatcggcgacgaaaatctgacggatatcataaatacaagacaccagaacgttaaatatctacccaatattgacctgccccataatctagtggccgatcctgatcttttacactccatcaagggtgctgacatccttgttttcaacatccctcatcaatttttaccaaacatagtcaaacaattgcaaggccacgtggcccctcatgtaagggccatctcgtgtctaaaagggttcgagttgggctccaagggtgtgcaattgctatcctcctatgttactgatgagttaggaatccaatgtggcgcactatctggtgcaaacttggcaccggaagtggccaaggagcattggtccgaaaccaccgtggcttaccaactaccaaaggattatcaaggtgatggcaaggatgtagatcataagattttgaaattgctgttccacagaccttacttccacgtcaatgtcatcgatgatgttgctggtatatccattgccggtgccttgaagaacgtcgtggcacttgcatgtggtttcgtagaaggtatgggatggggtaacaatgcctccgcagccattcaaaggctgggtttaggtgaaattatcaagttcggtagaatgtttttcccagaatccaaagtcgagacctactatcaagaatccgctggtgttgcagatctgatcaccacctgctcaggcggtagaaacgtcaaggttgccacatacatggccaagaccggtaagtcagccttggaagcagaaaaggaattgcttaacggtcaatccgcccaagggataatcacatgcagagaagttcacgagtggctacaaacatgtgagttgacccaagaattcccattattcgaggcagtctaccagatagtctacaacaacgtccgcatggaagacctaccggagatgattgaagagctagacatcgatgacgaatag

SEQ ID NO: 447 - protein, 440 aa, Saccharomyces cerevisiae
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 448 - DNA, 1518 bp, Saccharomyces cerevisiae
atgagtgaaggccccgtcaaattcgaaaaaaataccgtcatatctgtctttggtgcgtcaggtgatctggcaaagaagaagacttttcccgccttatttgggcttttcagagaaggttaccttgatccatctaccaagatcttcggttatgcccggtccaaattgtccatggaggaggacctgaagtcccgtgtcctaccccacttgaaaaaacctcacggtgaagccgatgactctaaggtcgaacagttcttcaagatggtcagctacatttcgggaaattacgacacagatgaaggcttcgacgaattaagaacgcagatcgagaaattcgagaaaagtgccaacgtcgatgtcccacaccgtctcttctatctggccttgccgccaagcgtttttttgacggtggccaagcagatcaagagtcgtgtgtacgcagagaatggcatcacccgtgtaatcgtagagaaacctttcggccacgacctggcctctgccagggagctgcaaaaaaacctggggcccctctttaaagaagaagagttgtacagaattgaccattacttgggtaaagagttggtcaagaatcttttagtcttgaggttcggtaaccagtttttgaatgcctcgtggaatagagacaacattcaaagcgttcagatttcgtttaaagagaggttcggcaccgaaggccgtggcggctatttcgactctataggcataatcagagacgtgatgcagaaccatctgttacaaatcatgactctcttgactatggaaagaccggtgtcttttgacccggaatctattcgtgacgaaaaggttaaggttctaaaggccgtggcccccatcgacacggacgacgtcctcttgggccagtacggtaaatctgaggacgggtctaagcccgcctacgtggatgatgacactgtagacaaggactctaaatgtgtcacttttgcagcaatgactttcaacatcgaaaacgagcgttgggagggcgtccccatcatgatgcgtgccggtaaggctttgaatgagtccaaggtggagatcagactgcagtacaaagcggtcgcatcgggtgtcttcaaagacattccaaataacgaactggtcatcagagtgcagcccgatgccgctgtgtacctaaagtttaatgctaagacccctggtctgtcaaatgctacccaagtcacagatctgaatctaacttacgcaagcaggtaccaagacttttggattccagaggcttacgaggtgttgataagagacgccctactgggtgaccattccaactttgtcagagatgacgaattggatatcagttggggcatattcaccccattactgaagcacatagagcgtccggacggtccaacaccggaaatttacccctacggatcaagaggtccaaagggattgaaggaatatatgcaaaaacacaagtatgttatgcccgaaaagcacccttacgcttggcccgtgactaagccagaagatacgaaggataattag

SEQ ID NO: 449 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 450 - DNA, 750 bp, Saccharomyces cerevisiae
atggtgacagtcggtgtgttttctgagagggctagtttgacccatcaattgggggaattcatcgtcaagaaacaagatgaggcgctgcaaaagaagtcagactttaaagtttccgttagcggtggctctttgatcgatgctctgtatgaaagtttagtagcggacgaatcactatcttctcgagtgcaatggtctaaatggcaaatctacttctctgatgaaagaattgtgccactgacggacgctgacagcaattatggtgccttcaagagagctgttctagataaattaccctcgactagtcagccaaacgtttatcccatggacgagtccttgattggcagcgatgctgaatctaacaacaaaattgctgcagagtacgagcgtatcgtacctcaagtgcttgatttggtactgttgggctgtggtcctgatggacacacttgttccttattccctggagaaacacataggtacttgctgaacgaaacaaccaaaagagttgcttggtgccacgattctcccaagcctccaagtgacagaatcaccttcactctgcctgtgttgaaagacgccaaagccctgtgttttgtggctgagggcagttccaaacaaaatataatgcatgagatctttgacttgaaaaacgatcaattgccaaccgcattggttaacaaattatttggtgaaaaaacatcctggttcgttaatgaggaagcttttggaaaagttcaaacgaaaactttttag

SEQ ID NO: 451 - protein, 249 aa, Saccharomyces cerevisiae
MVTVGVFSERASLTHQLGEFIVKKQDEALQKKSDFKVSVSGGSLIDALYESLVADESLSSRVQWSKWQIYFSDERIVPLTDADSNYGAFKRAVLDKLPSTSQPNVYPMDESLIGSDAESNNKIAAEYERIVPQVLDLVLLGCGPDGHTCSLFPGETHRYLLNETTKRVAWCHDSPKPPSDRITFTLPVLKDAKALCFVAEGSSKQNIMHEIFDLKNDQLPTALVNKLFGEKTSWFVNEEAFGKVQTKTF

SEQ ID NO: 452 - DNA, 768 bp, Saccharomyces cerevisiae
atggtgaaattacaaaggtttagcgaaaagaaaagcctcatacacgaattcggcaagtttatccttgaaaagcaagaatcggcgttaacgggcgacgctgatgcagtgttcaatatcgccatcagtggaggatcgatgaaccaagcgctgtacgaaagtttggtaaatgacaaaaacatttttccacatattaagtggccacaatggagaatcttcttctgtgacgaaagattggttccatttgaggatccgcaaagtaactatggtcagttcaaaaaaacagttttggacccgctagtgcatcagggcaaccaattgaacttaggccccactgtatacactatcaacgaatcattaatcggtggcggtgaaacggccaatagaaagattgccgaagaatacgcttccatgctgcctgcatcattcgacctaatcttactcggatgcggagaagatggacatacatgctcgttgtttcccggggttgaatttaattaccttgtagaagagatggaccgcaaggttttatggtgtaataattcgcccaaggcacccaaggacaggatcacctttacattagcagtagtagccgaggctaaaagtgtgtgctttctcgttaggggagctgctaaaaaggctatcatgcatgacgtgttaatcgtaaaaaatagcgaactacctagtgtgctggttaatgaaatggtcggaaccaaagtaacttggtttctcgacgacgaagctggcgccttgattcctgaaaactgctaa

SEQ ID NO: 453 - protein, 255 aa, Saccharomyces cerevisiae
MVKLQRFSEKKSLIHEFGKFILEKQESALTGDADAVFNIAISGGSMNQALYESLVNDKNIFPHIKWPQWRIFFCDERLVPFEDPQSNYGQFKKTVLDPLVHQGNQLNLGPTVYTINESLIGGGETANRKIAEEYASMLPASFDLILLGCGEDGHTCSLFPGVEFNYLVEEMDRKVLWCNNSPKAPKDRITFTLAVVAEAKSVCFLVRGAAKKAIMHDVLIVKNSELPSVLVNEMVGTKVTWFLDDEAGALIPENC

SEQ ID NO: 454 - DNA, 1470 bp, Saccharomyces cerevisiae
atgtctgctgatttcggtttgattggtttggccgtcatgggtcaaaatttgatcttgaacgctgctgaccacggtttcactgtttgtgcttacaacagaactcaatccaaggtcgaccatttcttggccaatgaagctaagggcaaatctatcatcggtgctacttccattgaagatttcatctccaaattgaagagacctagaaaggtcatgcttttggttaaagctggtgctccagttgacgctttgatcaaccaaatcgtcccacttttggaaaagggtgatattatcatcgatggtggtaactctcacttcccagattctaatagacgttacgaagaattgaagaagaagggtattcttttcgttggttctggtgtctccggtggtgaggaaggtgcccgttacggtccatctttgatgccaggtggttctgaagaagcttggccacatattaagaacatcttccaatccatctctgctaaatccgacggtgaaccatgttgcgaatgggttggcccagccggtgctggtcactacgtcaagatggttcacaacggtattgaatacggtgatatgcaattgatttgtgaagcttatgacatcatgaagagattgggtgggtttaccgataaggaaatcagtgacgtttttgccaaatggaacaatggtgtcttggattccttcttggtcgaaattaccagagatattttgaaattcgacgacgtcgacggtaagccattagttgaaaaaatcatggatactgctggtcaaaagggtactggtaagtggactgccatcaacgccttggatttgggtatgccagttactttgattggtgaagctgtctttgcccgttgtctatctgctttgaagaacgagagaattagagcctccaaggtcttaccaggcccagaagttccaaaagacgccgtcaaggacagagaacaatttgtcgatgatttggaacaagctttgtatgcttccaagattatttcttacgctcaaggtttcatgttgatccgtgaagctgctgctacttatggctggaaactaaacaaccctgccatcgctttgatgtggagaggtggttgtatcattagatctgttttcttgggtcaaatcacaaaggcctacagagaagaaccagatttggaaaacttgttgttcaacaagttcttcgctgatgccgtcaccaaggctcaatctggttggagaaagtcaattgcgttggctaccacctacggtatcccaacaccagccttttccaccgctttgtctttctacgatgggtacagatctgaaagattgccagccaacttactacaagctcaacgtgactactttggtgctcacactttcagagtgttgccagaatgtgcttctgacaacttgccagtagacaaggatatccatatcaactggactggccacggtggtaatgtttcttcctctacataccaagcttaa

SEQ ID NO: 455 - protein, 489 aa, Saccharomyces cerevisiae
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 456 - DNA, 1479 bp, Saccharomyces cerevisiae
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 457 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 458 - DNA, 22 bp, Artificial sequence
  Primer oBP440
tacgtacggaccaatcgaagtg

SEQ ID NO: 459 - DNA, 49 bp, Artificial sequence
  Primer oBP441
aattcgtttgagtacactactaatggctttgttggcaatatgtttttgc

SEQ ID NO: 460 - DNA, 49 bp, Artificial sequence
  Primer oBP442
atatagcaaaaacatattgccaacaaagccattagtagtgtactcaaac

SEQ ID NO: 461 - DNA, 49 bp, Artificial sequence
  oBP443
tatggaccctgaaaccacagccacattcttgttatttataaaaagacac

SEQ ID NO: 462 - DNA, 49 bp, Artificial sequence
  Primer oBP444
ctcccgtgtctttttataaataacaagaatgtggctgtggtttcagggt

SEQ ID NO: 463 - DNA, 49 bp, Artificial sequence
  Primer oBP445
taccgtaggcgtccttaggaaagatagaaggccatgaagctttttcttt

SEQ ID NO: 464 - DNA, 49 bp, Artificial sequence
  Primer oBP446
attggaaagaaaaagcttcatggccttctatctttcctaaggacgccta

SEQ ID NO: 465 - DNA, 4586 bp, Artificial sequence
  pLA54 template DNA
gggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgcattgcggattacgtattctaatgttcagataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgtttttttttgttttgttctcactgtatttacatttctatttagtatttagttattcatataatctataacttcgtatagcatacattatacgaagttatccagtgatgatacaacgagttagccaaggtg

SEQ ID NO: 466 - DNA, 80 bp, Artificial sequence
  Primer BK505
ttccggtttctttgaaatttttttgattcggtaatctccgagcagaaggagcattgcggattacgtattctaatgttcag

SEQ ID NO: 467 - DNA, 81 bp, Artificial sequence
  Primer BK506
gggtaataactgatataattaaattgaagctctaatttgtgagtttagtacaccttggctaactcgttgtatcatcactgg

SEQ ID NO: 468 - DNA, 38 bp, Artificial sequence
  Primer LA468
gcctcgagttttaatgttacttctcttgcagttaggga

SEQ ID NO: 469 - DNA, 31 bp, Artificial sequence
  Primer LA492
gctaaattcgagtgaaacacaggaagaccag

SEQ ID NO: 470 - DNA, 24 bp, Artificial sequence
  Primer oBP452
ttctcgacgtgggcctttttcttg

SEQ ID NO: 471 - DNA, 49 bp, Artificial sequence
  Primer oBP453
tgcagctttaaataatcggtgtcactactttgccttcgtttatcttgcc

SEQ ID NO: 472 - DNA, 49 bp, Artificial sequence
  Primer oBP454
gagcaggcaagataaacgaaggcaaagtagtgacaccgattatttaaag

SEQ ID NO: 473 - DNA, 49 bp, Artificial sequence
  Primer oBP455
tatggaccctgaaaccacagccacattgtaaccaccacgacggttgttg

SEQ ID NO: 474 - DNA, 49 bp, Artificial sequence
  Primer oBP456
tttagcaacaaccgtcgtggtggttacaatgtggctgtggtttcagggt

SEQ ID NO: 475 - DNA, 49 bp, Artificial sequence
  Primer oBP457
ccagaaaccctatacctgtgtggacgtaaggccatgaagctttttcttt

SEQ ID NO: 476 - DNA, 49 bp, Artificial sequence
  Primer oBP458
attggaaagaaaaagcttcatggccttacgtccacacaggtatagggtt

SEQ ID NO: 477 - DNA, 22 bp, Artificial sequence
  Primer oBP459
cataagaacacctttggtggag

SEQ ID NO: 478 - DNA, 22 bp, Artificial sequence
  Primer oBP460
aggattatcattcataagtttc

SEQ ID NO: 479 - DNA, 23 bp, Artificial sequence
  Primer oBP461
ttcttggagctgggacatgtttg

SEQ ID NO: 480 - DNA, 7523 bp, Artificial sequence
  pRS423::PGAL1-cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 481 - DNA, 22 bp, Artificial sequence
  Primer oBP450
tgatgatatttcataaataatg

SEQ ID NO: 482 - DNA, 23 bp, Artificial sequence
  Primer oBP451
atgcgtccatctttacagtcctg

SEQ ID NO: 483 - DNA, 21 bp, Artificial sequence
  Primer oBP447
ttattgtttggcatttgtagc

SEQ ID NO: 484 - DNA, 22 bp, Artificial sequence
  Primer oBP448
ccaagcatctcataaacctatg

SEQ ID NO: 485 - DNA, 22 bp, Artificial sequence
  Primer oBP449
tgtgcagatgcagatgtgagac

SEQ ID NO: 486 - DNA, 17 bp, Artificial sequence
  oBP554
agttattgataccgtac

SEQ ID NO: 487 - DNA, 19 bp, Artificial sequence
  Primer oBP555
cgagataccgtaggcgtcc

SEQ ID NO: 488 - DNA, 24 bp, Artificial sequence
  Primer oBP513
ttatgtatgctcttctgacttttc

SEQ ID NO: 489 - DNA, 49 bp, Artificial sequence
  Primer oBP515
aataattagagattaaatcgctcattttttgccagtttcttcaggcttc

SEQ ID NO: 490 - DNA, 49 bp, Artificial sequence
  Primer oBP516
agcctgaagaaactggcaaaaaatgagcgatttaatctctaattattag

SEQ ID NO: 491 - DNA, 49 bp, Artificial sequence
  Primer oBP517
tatggaccctgaaaccacagccacatttttcaatcattggagcaatcat

SEQ ID NO: 492 - DNA, 49 bp, Artificial sequence
  Primer oBP518
taaaatgattgctccaatgattgaaaaatgtggctgtggtttcagggtc

SEQ ID NO: 493 - DNA, 49 bp, Artificial sequence
  Primer oBP519
accgtaggtgttgtttgggaaagtggaaggccatgaagctttttctttc

SEQ ID NO: 494 - DNA, 49 bp, Artificial sequence
  Primer oBP520
ttggaaagaaaaagcttcatggccttccactttcccaaacaacacctac

SEQ ID NO: 495 - DNA, 23 bp, Artificial sequence
  Primer oBP521
ttattgcttagcgttggtagcag

SEQ ID NO: 496 - DNA, 21 bp, Artificial sequence
  Primer oBP511
tttttggtggttccggcttcc

SEQ ID NO: 497 - DNA, 22 bp, Artificial sequence
  Primer oBP512
aaagttggcatagcggaaactt

SEQ ID NO: 498 - DNA, 16 bp, Artificial sequence
  Primer oBP550
gtcattgacaccatct

SEQ ID NO: 499 - DNA, 19 bp, Artificial sequence
  Primer oBP551
agagataccgtaggtgttg

SEQ ID NO: 500 - DNA, 33 bp, Artificial sequence
  Primer oBP530
aattggcgcgccatgaaagctctggtttatcac

SEQ ID NO: 501 - DNA, 49 bp, Artificial sequence
  Primer oBP531
tgaatcatgagttttatgttaattagctcaggcagcgcctgcgttcgag

SEQ ID NO: 502 - DNA, 49 bp, Artificial sequence
  Primer oBP532
atcctctcgaacgcaggcgctgcctgagctaattaacataaaactcatg

SEQ ID NO: 503 - DNA, 34 bp, Artificial sequence
  Primer oBP533
aattgtttaaacaagtaaataaattaatcagcat

SEQ ID NO: 504 - DNA, 49 bp, Artificial sequence
  Primer oBP536
acacaatacaataacaagaagaacaaaatgaaagctctggtttatcacg

SEQ ID NO: 505 - DNA, 49 bp, Artificial sequence
  Primer oBP546
agcgtatacatctgttgggaaagtagaaggccatgaagctttttctttc

SEQ ID NO: 506 - DNA, 49 bp, Artificial sequence
  Primer oBP547
ttggaaagaaaaagcttcatggccttctactttcccaacagatgtatac

SEQ ID NO: 507 - DNA, 22 bp, Artificial sequence
  Primer oBP539
ttattgtttagcgttagtagcg

SEQ ID NO: 508 - DNA, 72 bp, Artificial sequence
  Primer oBP542
cataatcaatctcaaagagaacaacacaatacaataacaagaagaacaaaatgaaagctctggtttatcacg

SEQ ID NO: 509 - DNA, 21 bp, Artificial sequence
  Primer oBP540
taggcataatcaccgaagaag

SEQ ID NO: 510 - DNA, 21 bp, Artificial sequence
  Primer oBP541
aaaatggtaagcagctgaaag

SEQ ID NO: 511 - DNA, 17 bp, Artificial sequence
  Primer oBP552
agttgttagaactgttg

SEQ ID NO: 512 - DNA, 19 bp, Artificial sequence
  Primer oBP553
gacgatagcgtatacatct

SEQ ID NO: 513 - DNA, 22 bp, Artificial sequence
  Primer oBP582
cttagcctctagccatagccat

SEQ ID NO: 514 - DNA, 23 bp, Artificial sequence
  AA270
ttagttttgctggccgcatcttc

SEQ ID NO: 515 - DNA, 21 bp, Artificial sequence
  oBP591
cccattaatatactattgaga

SEQ ID NO: 516 - DNA, 57 bp, Artificial sequence
  oBP438
aattggatccggcgcgccgtttaaacggccggccaatgtggctgtggtttcagggtc

SEQ ID NO: 517 - DNA, 49 bp, Artificial sequence
  Primer oBP439
aatttctagattaattaagcggccgcaaggccatgaagctttttctttc

SEQ ID NO: 518 - DNA, 21 bp, Artificial sequence
  Primer oBP264
tcggtgcgggcctcttcgcta

SEQ ID NO: 519 - DNA, 21 bp, Artificial sequence
  Primer oBP265
aatgtgagttagctcactcat

SEQ ID NO: 520 - DNA, 15456 bp, Artificial sequence
  pLH468-sadB
aaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaggcagcgcctgcgttcgagaggatgatcttcatcgccttctccttggcgccattgaggaatacctgataggcgtgctcgatctcggccagctcgaagcgatgggtaatcatcttcttcaacggaagcttgtcggtcgaggcgaccttcatcagcatgggcgtcgtgttcgtgttcaccagtcccgtggtgatcgtcaggttcttgatccagagcttctgaatctcgaagtcaaccttgacgccatgcacgccgacgttggcgatgtgcgcgccgggcttgacgatctcctggcagatgtcccaagtcgccggtatgcccaccgcctcgatcgcaacatcgactccctctgccgcaatcctatgcacggcttcgacaacgttctccgtgccggagttgatggtgtgcgttgccccgagctccttggcgagctggaggcgattctcgtccatgtcgatcacgatgatggtcgagggggagtagaactgggcggtcaacagtacggacatgccgacggggcccgcgccgacaatagccaccgcatcgcccggctggacattcccatactggacgccgatttcgtggccggtgggcaggatgtcgctcagcaggacggcgatttcgtcgtcaattgtctgggggatcttgtagaggctgttgtcggcatgcgggatgcggacgtattcggcctgcacgccatcgatcatgtaacccaggatccacccgccgtcgcggcaatgggagtaaagctgcttcttgcagtagtcgcacgagccgcaagaagtgacgcaggaaatcaggaccttgtcgcctttcttgaactgcgtgacactctcgcccacttcctcgatgacgcctaccccttcatggcccaggatgcgcccgtcggcgacctctggattcttgcctttgtagatgccgagatccgtgccgcagatcgtggtcttcaaaacccgtactactacatccgtgggcttttgaagggtgggcttgggcttgtcttcaagcgagatcttgtggtcaccgtgataaaccagagctttcatcctcagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtct

SEQ ID NO: 521 - DNA, 2686 bp, Artificial sequence
  pUC19
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 522 - DNA, 90 bp, Artificial sequence
  Primer LA512
gtattttggtagattcaattctctttccctttccttttccttcgctccccttccttatcagcattgcggattacgtattctaatgttcag

SEQ ID NO: 523 - DNA, 90 bp, Artificial sequence
  Primer LA513
ttggttgggggaaaaagaggcaacaggaaagatcagagggggagggggggggagagtgtcaccttggctaactcgttgtatcatcactgg

SEQ ID NO: 524 - DNA, 1559 bp, Artificial sequence
  loxP-URA3-loxP
gcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtg

SEQ ID NO: 525 - DNA, 2237 bp, Artificial sequence
  PDC1 Fragment A-ilvDSm
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattatt

SEQ ID NO: 526 - DNA, 4420 bp, Artificial sequence
  PDC1 A-ilvDSm-BUC cassette
ttatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccctttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttgcaatcagatttgggtttgttccctttattttcatatttcttgtcatattcctttctcaattattattttctactcataacctcacgcaaaataacacagtcaaatcaatcaaaatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaaaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttccactttcccaaacaacacctacggtatctctcaagtcttatggggttccattggtttcaccactggtgctaccttgggtgctgctttcgctgctgaagaaattgatccaaagaagagagttatcttattcattggtgacggttctttgcaattgactgttcaagaaatctccaccatgatcagatggggcttgaagccatacttgttcgtcttgaacaacgatggttacaccattgaaaagttgattcacggtccaaaggctcaatacaacgaaattcaaggttgggaccacctatccttgttgccaactttcggtgctaaggactatgaaacccacagagtcgctaccaccggtgaatgggacaagttgacccaagacaagtctttcaacgacaactctaagatcagaatgattgaaatcatgttgccagtcttcgatgctccacaaaacttggttgaacaagctaagttgactgctgctaccaacgctaagcaataa

SEQ ID NO: 527 - DNA, 3521 bp, Artificial sequence
  PDC5 A-sadB-BUC cassette
aaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatcaatatactgtagtaagtcctttcctctctttcttattacacttatttcacataatcaatctcaaagagaacaacacaatacaataacaagaagaacaaaatgaaagctctggtttatcacggtgaccacaagatctcgcttgaagacaagcccaagcccacccttcaaaagcccacggatgtagtagtacgggttttgaagaccacgatctgcggcacggatctcggcatctacaaaggcaagaatccagaggtcgccgacgggcgcatcctgggccatgaaggggtaggcgtcatcgaggaagtgggcgagagtgtcacgcagttcaagaaaggcgacaaggtcctgatttcctgcgtcacttcttgcggctcgtgcgactactgcaagaagcagctttactcccattgccgcgacggcgggtggatcctgggttacatgatcgatggcgtgcaggccgaatacgtccgcatcccgcatgccgacaacagcctctacaagatcccccagacaattgacgacgaaatcgccgtcctgctgagcgacatcctgcccaccggccacgaaatcggcgtccagtatgggaatgtccagccgggcgatgcggtggctattgtcggcgcgggccccgtcggcatgtccgtactgttgaccgcccagttctactccccctcgaccatcatcgtgatcgacatggacgagaatcgcctccagctcgccaaggagctcggggcaacgcacaccatcaactccggcacggagaacgttgtcgaagccgtgcataggattgcggcagagggagtcgatgttgcgatcgaggcggtgggcataccggcgacttgggacatctgccaggagatcgtcaagcccggcgcgcacatcgccaacgtcggcgtgcatggcgtcaaggttgacttcgagattcagaagctctggatcaagaacctgacgatcaccacgggactggtgaacacgaacacgacgcccatgctgatgaaggtcgcctcgaccgacaagcttccgttgaagaagatgattacccatcgcttcgagctggccgagatcgagcacgcctatcaggtattcctcaatggcgccaaggagaaggcgatgaagatcatcctctcgaacgcaggcgctgcctgagctaattaacataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttacttgtttaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttctactttcccaacagatgtatacgctatcgtccaagtcttgtggggttccattggtttcacagtcggcgctctattgggtgctactatggccgctgaagaacttgatccaaagaagagagttattttattcattggtgacggttctctacaattgactgttcaagaaatctctaccatgattagatggggtttgaagccatacatttttgtcttgaataacaacggttacaccattgaaaaattgattcacggtcctcatgccgaatataatgaaattcaaggttgggaccacttggccttattgccaacttttggtgctagaaactacgaaacccacagagttgctaccactggtgaatgggaaaagttgactcaagacaaggacttccaagacaactctaagattagaatgattgaagttatgttgccagtctttgatgctccacaaaacttggttaaacaagctcaattgactgccgctactaacgctaaacaataa

SEQ ID NO: 528 - DNA, 1685 bp, Artificial sequence
  gpd2::loxP-URA3-loxP cassette
gtattttggtagattcaattctctttccctttccttttccttcgctccccttccttatcagcattgcggattacgtattctaatgttcagataacttcgtatagcatacattatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtatagcatacattatacgaagttatccagtgatgatacaacgagttagccaaggtgacactctccccccccctccccctctgatctttcctgttgcctctttttcccccaaccaa

SEQ ID NO: 529 - DNA, 22 bp, Artificial sequence
  Primer oBP594
agctgtctcgtgttgtgggttt

SEQ ID NO: 530 - DNA, 49 bp, Artificial sequence
  Primer oBP595
cttaataatagaacaatatcatcctttacgggcatcttatagtgtcgtt

SEQ ID NO: 531 - DNA, 49 bp, Artificial sequence
  Primer oBP596
gcgccaacgacactataagatgcccgtaaaggatgatattgttctatta

SEQ ID NO: 532 - DNA, 49 bp, Artificial sequence
  Primer oBP597
tatggaccctgaaaccacagccacattgcaacgacgacaatgccaaacc

SEQ ID NO: 533 - DNA, 49 bp, Artificial sequence
  Primer oBP598
tccttggtttggcattgtcgtcgttgcaatgtggctgtggtttcagggt

SEQ ID NO: 534 - DNA, 49 bp, Artificial sequence
  Primer oBP599
atcctctcgcggagtccctgttcagtaaaggccatgaagctttttcttt

SEQ ID NO: 535 - DNA, 49 bp, Artificial sequence
  Primer oBP600
attggaaagaaaaagcttcatggcctttactgaacagggactccgcgag

SEQ ID NO: 536 - DNA, 22 bp, Artificial sequence
  Primer oBP601
tcataccacaatcttagaccat

SEQ ID NO: 537 - DNA, 21 bp, Artificial sequence
  Primer oBP602
tgttcaaacccctaaccaacc

SEQ ID NO: 538 - DNA, 22 bp, Artificial sequence
  Primer oBP603
tgttcccacaatctattaccta

SEQ ID NO: 539 - DNA, 21 bp, Artificial sequence
  Primer oBP605
tactgaacagggactccgcga

SEQ ID NO: 540 - DNA, 21 bp, Artificial sequence
  Primer oBP606
tcataccacaatcttagacca

SEQ ID NO: 541 - DNA, 34 bp, Artificial sequence
  Primer oBP562
aattgtttaaacatgtatacagtaggtgactatc

SEQ ID NO: 542 - DNA, 49 bp, Artificial sequence
  Primer oBP563
aatcataaatcataagaaattcgcttatcagctcttgttttgttctgca

SEQ ID NO: 543 - DNA, 49 bp, Artificial sequence
  Primer oBP564
ttatttgcagaacaaaacaagagctgataagcgaatttcttatgattta

SEQ ID NO: 544 - DNA, 34 bp, Artificial sequence
  Primer oBP565
aattggccggccaaaaaaagcatgcacgtataca

SEQ ID NO: 545 - DNA, 32 bp, Artificial sequence
  Primer oBP505
aattgagctcactgtagccctagacttgatag

SEQ ID NO: 546 - DNA, 35 bp, Artificial sequence
  Primer oBP506
aattggcgcgcctgtatatgagatagttgattgta

SEQ ID NO: 547 - DNA, 35 bp, Artificial sequence
  Primer oBP507
aattttaattaagtctaggttctttggctgttcaa

SEQ ID NO: 548 - DNA, 33 bp, Artificial sequence
  Primer oBP508
aattgtcgactttagaagtgtcaacaacgtatc

SEQ ID NO: 549 - DNA, 34 bp, Artificial sequence
  Primer oBP674
aattggcgcgccaattaccgtcgctcgtgatttg

SEQ ID NO: 550 - DNA, 34 bp, Artificial sequence
  Primer oBP675
aattgtttaaacttgaatatgtattacttggtta

SEQ ID NO: 551 - DNA, 22 bp, Artificial sequence
  Primer oBP495
ggagatatacaatagaacagat

SEQ ID NO: 552 - DNA, 22 bp, Artificial sequence
  Primer oBP496
tagcaatggggtttttttcagt

SEQ ID NO: 553 - DNA, 15539 bp, Artificial sequence
  pLH468
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggcctcagctcttgttttgttctgcaaataacttacccatctttttcaaaactttaggtgcaccctcctttgctagaataagttctatccaatacatcctatttggatctgcttgagcttctttcatcacggatacgaattcattttctgttctcacaattttggacacaactctgtcttccgttgccccgaaactttctggcagttttgagtaattccacataggaatgtcattataactctggttcggaccatgaatttccctctcaaccgtgtaaccatcgttattaatgataaagcagattgggtttatcttctctctaatggctagtcctaattcttggacagtcagttgcaatgatccatctccgataaacaataaatgtctagattctttatctgcaatttggctgcctagagctgcggggaaagtgtatcctatagatccccacaagggttgaccaataaaatgtgatttcgatttcagaaatatagatgaggcaccgaagaaagaagtgccttgttcagccacgatcgtctcattactttgggtcaaattttcgacagcttgccacagtctatcttgtgacaacagcgcgttagaaggtacaaaatcttcttgctttttatctatgtacttgcctttatattcaatttcggacaagtcaagaagagatgatatcagggattcgaagtcgaaattttggattctttcgttgaaaattttaccttcatcgatattcaaggaaatcattttattttcattaagatggtgagtaaatgcacccgtactagaatcggtaagctttacacccaacataagaataaaatcagcagattccacaaattccttcaagtttggctctgacagagtaccgttgtaaatccccaaaaatgagggcaatgcttcatcaacagatgatttaccaaagttcaaagtagtaataggtaacttagtctttgaaataaactgagtaacagtcttctctaggccgaacgatataatttcatggcctgtgattacaattggtttcttggcattcttcagactttcctgtattttgttcagaatctcttgatcagatgtattcgacgtggaattttccttcttaagaggcaaggatggtttttcagccttagcggcagctacatctacaggtaaattgatgtaaaccggctttctttcctttagtaaggcagacaacactctatcaatttcaacagttgcattctcggctgtcaataaagtcctggcagcagtaaccggttcgtgcatcttcataaagtgcttgaaatcaccatcagccaacgtatggtgaacaaacttaccttcgttctgcactttcgaggtaggagatcccacgatctcaacaacaggcaggttctcagcataggagcccgctaagccattaactgcggataattcgccaacaccaaatgtagtcaagaatgccgcagcctttttcgttcttgcgtacccgtcggccatataggaggcatttaactcattagcatttcccacccatttcatatctttgtgtgaaataatttgatctagaaattgcaaattgtagtcacctggtactccgaatatttcttctatacctaattcgtgtaatctgtccaacagatagtcacctactgtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaactgaaaaagcgtgttttttattcaaaatgattctaactcccttacgtaatcaaggaatctttttgccttggcctccgcgtcattaaacttcttgttgttgacgctaacattcaacgctagtatatattcgtttttttcaggtaagttcttttcaacgggtcttactgatgaggcagtcgcgtctgaacctgttaagaggtcaaatatgtcttcttgaccgtacgtgtcttgcatgttattagctttgggaatttgcatcaagtcataggaaaatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 554 - DNA, 8366 bp, Artificial sequence
  pRS316-UAS(PGK1)-PFBA1-GUS
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccacgcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaggggggatgtgctgcaaggcgattaagttgggtaacgccagggttttcccagtcacgacgttgtaaaacgacggccagtgaattgtaatacgactcactatagggcgaattggagctccaccgcggtggtttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgctttctgataattaaacgcttggcgtttaatcttttttgccgattaataatattattattaccctcttatttattagcattgtcttccgtactaaaaggagtagggaaaaaggcgaagtagagtgacacgtccattacccagcgcttcataagaatccatcaggtatattaaattgtgatgggagaacaaaacaaattgtactatgatgtcgagaaattggtgaattctttgcaggaaagttttgacctggattgcgcgcaaagtgtatcacttttcaccagtaaatcaaggagcaatgaggcttggttggaagagctagagaataaattcaagttaaaagatgatgttgaacttgatgatgtggaaaatttaagagccgaaattgacatgaagttaaatatgttggaggataaagtaagctactatgaaagactttacaaagaactcgaagagttccagaatgaaataaaaattaaaacagttgtgaataacagaagacaatcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgctctagttaattaatcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggagtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacgtaccatactagtttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcgtcgacaggaccttgttgtgtgacgaaattggaagctgcaatcaataggaagacaggaagtcgagcgtgtctgggttttttcagttttgttctttttgcaaacaaatcacgagcgacggtaattggtacccagcttttgttccctttagtgagggttaattccgagcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctcggcccccctgacgagcatcacaaaaatcgacgctcaagtcagaggtggcgaaacccgacaggactataaagataccaggcgttcccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactgcccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgaaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 555 - DNA, 9593 bp, Artificial sequence
  pYZ090deltaAlsS
ggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactag

SEQ ID NO: 556 - DNA, 12896 bp, Artificial sequence
  pBP915
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggcgcgccactggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccacccgggccccccctcgaggtcgacggtatcgataagcttgatatcgaattcctgcagcccgggggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaaaaagttaaaattgtacgaatagattcaccacttcttaacaaatcaaacccttcattgattttctcgaatggcaatacatgtgtaattaaaggatcaagagcaaacttcttcgccataaagtcggcaacaagttttggaacactatccttgctcttaaaaccgccaaatatagctcccttccatgtacgaccgcttagcaacagcataggattcatcgacaaattttgtgaatcaggaggaacacctacgatcacactgactccatatgcctcttgacagcaggacaacgcagttaccatagtatcaagacggcctataacttcaaaagagaaatcaactccaccgtttgacatttcagtaaggacttcttgtattggtttcttataatcttgagggttaacacattcagtagccccgacctccttagcttttgcaaatttgtccttattgatgtctacacctataatcctcgctgcgcctgcagctttacaccccataataacgcttagtcctactcctcctaaaccgaatactgcacaagtcgaaccctgtgtaacctttgcaactttaactgcggaaccgtaaccggtggaaaatccgcaccctatcaagcaaactttttccagtggtgaagctgcatcgattttagcgacagatatctcgtccaccactgtgtattgggaaaatgtagaagtaccaaggaaatggtgtataggtttccctctgcatgtaaatctgcttgtaccatcctgcatagtacctctaggcatagacaaatcatttttaaggcagaaattaccctcaggatgtttgcagactctacacttaccacattgaggagtgaacagtgggatcactttatcaccaggacgaacagtggtaacaccttcacctatggattcaacgattccggcagcctcgtgtcccgcgattactggcaaaggagtaactagagtgccactcaccacatggtcgtcggatctacagattccggtggcaaccatcttgattctaacctcgtgtgcttttggtggcgctacttctacttcttctatgctaaacggctttttctcttcccacaaaactgccgctttacacttaataactttaccggctgttgacatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcatgcggatcccccgggctgcaggaattcgatatcaagcttatcgataccgtcgactggccattaatctttcccatattagatttcgccaagccatgaaagttcaagaaaggtctttagacgaattacccttcatttctcaaactggcgtcaagggatcctggtatggttttatcgttttatttctggttcttatagcatcgttttggacttctctgttcccattaggcggttcaggagccagcgcagaatcattctttgaaggatacttatcctttccaattttgattgtctgttacgttggacataaactgtatactagaaattggactttgatggtgaaactagaagatatggatcttgataccggcagaaaacaagtagatttgactcttcgtagggaagaaatgaggattgagcgagaaacattagcaaaaagatccttcgtaacaagatttttacatttctggtgttgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatcttggctctcttgggctcaaggtgacaaggtcctcgaaaatagggcgcgccccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 557 - DNA, 38 bp, Artificial sequence; identical to SEQ ID NO: 468
  Primer BK468

SEQ ID NO: 558 - DNA, 30 bp, Artificial sequence
  N1110
gcgatttaatctctaattattagttaaagt

SEQ ID NO: 559 - DNA, 22 bp, Artificial sequence
  Primer N160SeqF5
cctgaagtctaggtccctattt

SEQ ID NO: 560 - DNA, 7589 bp, Artificial sequence
  pUC19-kan::pdc1::FBA-alsS::TRX1
tatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaaggccgcccgcaaattaaagccttcgagcgtcccaaaaccttctcaagcaaggttttcagtataatgttacatgcgtacacgcgtctgtacagaaaaaaaagaaaaatttgaaatataaataacgttcttaatactaacataactataaaaaaataaatagggacctagacttcaggttgtctaactccttccttttcggttagagcggatgtggggggagggcgtgaatgtaagcgtgacataactaattacatgattaattaactagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagctggtctggtgattctacgcgcaagccagttgctccgaagctttccgcatatttcacgatatcgatatttccgaaatcgaccgcagatgtacggttatattttttcaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattccactttcacagcatcgtgttcgatatgattgatcgtggacggaatgtcaccgatcaattcaagatcaggctggtaagcatgatcaatgtcagcgataatctcgtctaaatggataattgtccggtctccattgatattccagaatttcggatcatattcaatcgggtcatagccgatcgtcagaacaacatctgcctgctctagcagtaaatcgccaggctggttgcggaacaaaccgatacggccaaaatattgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgggcaacgataatttcaggtcctttatcttgtaaagcgtcaaataccgcatcaatttttgcacctggaatgccaaatacatgtgtgacaccttgctccactaagcaatcaacaacaagctccgcccctctgtttttcacaagggatttttgttcttttgttgcttttgtcaacatcctcagctctagatttgaatatgtattacttggttatggttatatatgacaaaagaaaaagaagaacagaagaataacgcaaggaagaacaataactgaaattgatagagaagtattatgtctttgtctttttataataaatcaagtgcagaaatccgttagacaacatgagggataaaatttaacgtgggcgaagaagaaggaaaaaagtttttgtgagggcgtaattgaagcgatctgttgattgtagattttttttttttgaggagtcaaagtcagaagagaacagacaaatggtattaaccatccaatacttttttggagcaacgctaagctcatgcttttccattggttacgtgctcagttgttagatatggaaagagaggatgctcacggcagcgtgactccaattgagcccgaaagagaggatgccacgttttcccgacggctgctagaatggaaaaaggaaaaatagaagaatcccattcctatcattatttacgtaatgacccacacatttttgagattttcaactattacgtattacgataatcctgctgtcattatcattattatctatatcgacgtatgcaacgtatgtgaagccaagtaggcaattatttagtactgtcagtattgttattcatttcagatcttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccgactctagaggatcccccaccttggctaactcgttgtatcatcactggataacttcgtatagcatacattatacgaagttatctagggattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaactcgagatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagtttaacttgatactactagattttttctcttcatttataaaatttttggttataattgaagctttagaagtatgaaaaaatccttttttttcattctttgcaaccaaaataagaagcttcttttattcattgaaatgatgaatataaacctaacaaaagaaaaagactcgaatatcaaacattaaaaaaaaataaaagaggttatctgttttcccatttagttggagtttgcattttctaatagatagaactctcaattaatgtggatttagtttctctgttcgataacttcgtatagcatacattatacgaagttatctgaacattagaatacgtaatccgcaatgcggggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttt

SEQ ID NO: 561 - DNA, 10934 bp, Artificial sequence
  pRS423::TEF(M4)-xpk1+ENO1-eutD
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcgcccgggccactagtcagatgccgcgggcacttgagcacctcatgcacagcaataacacaacacaatggttagtagcaacctgaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgc

SEQ ID NO: 562 - DNA, 9220 bp, Artificial sequence
  pUC19-URA3::pdc1::TEF(M4)-xpk1::kan
ccgcattgcggattacgtattctaatgttcagataacttcgtataatgtatgctatacgaagttatcgaacagagaaactaaatccacattaattgagagttctatctattagaaaatgcaaactccaactaaatgggaaaacagataacctcttttatttttttttaatgtttgatattcgagtctttttcttttgttaggtttatattcatcatttcaatgaataaaagaagcttcttattttggttgcaaagaatgaaaaaaaaggattttttcatacttctaaagcttcaattataaccaaaaattttataaatgaagagaaaaaatctagtagtatcaagttaaacttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatctcgagttttaatgttacttctcttgcagttagggaactataatgtaactcaaaataagattaaacaaactaaaataaaaagaagttatacagaaaaacccatataaaccagtactaatccataataataatacacaaaaaaactatcaaataaaaccagaaaacagattgaatagaaaaattttttcgatctccttttatattcaaaattcgatatatgaaaaagggaactctcagaaaatcaccaaatcaatttaattagatttttcttttccttctagcgttggaaagaaaaatttttctttttttttttagaaatgaaaaatttttgccgtaggaatcaccgtataaaccctgtataaacgctactctgttcacctgtgtaggctatgattgacccagtgttcattgttattgcgagagagcgggagaaaagaaccgatacaagagatccatgctggtatagttgtctgtccaacactttgatgaacttgtaggacgatgatgtgtatttagacgagtacgtgtgtgactattaagtagttatgatagagaggtttgtacggtgtgttctgtgtaattcgattgagaaaatggttatgaatccctagataacttcgtataatgtatgctatacgaagttatccagtgatgatacaacgagttagccaaggtgggggatcctctagagtcttaaggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctatccgcggtggttaagcctaaccaggccaattcaacagactgtcggcaacttcttgtctggtctttccatggtaagtgacagtgcagtaataatatgaaccaatttatttttcgttacataaaaatgcttataaaactttaactaataattagagattaaatcgcaaacggccggccaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggccttgcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgttttatttgtatcgaggtgtctagtcttctattacactaatgcagtttcagggttttggaaaccacactgtttaaacagtgttccttaatcaaggatacctctttttttttccttggttccactaattcatcggttttttttttggaagacatcttttccaacgaaaagaatatacatatcgtttaagagaaattctccaaatttgtaaagaagcggacccagacttaa

SEQ ID NO: 563 - DNA, 19 bp, Artificial sequence
  Primer N160SeqR5
tgagcccgaaagagaggat

SEQ ID NO: 564 - DNA, 38 bp, Artificial sequence
  Primer N821
cgcccgggccactagtcagatgccgcgggcacttgagc

SEQ ID NO: 565 - DNA, 44 bp, Artificial sequence
  Primer N822
cgcctcagctttgatttagtgtttgtgtgttgataagcagttgc

SEQ ID NO: 566 - DNA, 20 bp, Artificial sequence
  Primer N886
caatgattgttggtaaaggg

SEQ ID NO: 567 - DNA, 30 bp, Artificial sequence
  Primer N1114
atatgctggtgatgagtaatctgttgtcat

SEQ ID NO: 568 - DNA, 30 bp, Artificial sequence
  Primer N1115
tttttgtgctaatgactcaaataaatccat

SEQ ID NO: 569 - DNA, 62 bp, Artificial sequence
  Primer N1176
gcatagcaatctaatctaagttccagctgaggatgacaacagattactcatcaccagcatat

SEQ ID NO: 570 - DNA, 62 bp, Artificial sequence
  Primer N1177
atcaacacacaaacactaaatcaaagctgaggatggatttatttgagtcattagcacaaaaa

SEQ ID NO: 571 - DNA, 63 bp, Artificial sequence
  Primer N1178
ggtatcgataagcttgatatcgaattcctgcgcccgggccactagtcagatgccgcgggcact

SEQ ID NO: 572 - DNA, 30 bp, Artificial sequence
  Primer N1214
aaaaagggggtagaagcgttttgaagctat

SEQ ID NO: 573 - DNA, 22 bp, Artificial sequence
  Primer oBP512
aaagttggcatagcggaaactt

SEQ ID NO: 574 - DNA, 7463 bp, Artificial sequence
  pRS423:GAL1p-Cre
ccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttatgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtccgccaccgcggtggagct

SEQ ID NO: 575 - DNA, 11017 bp, Artificial sequence
  pRS426::GPD-xpk1+ADH-eutD
gatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcggatagatctagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaataaacacacataaacgctgaggatgacaacagattactcatcaccagcatatttgcaaaaagttgataagtactggcgtgctgccaactacttatcagttggtcaactttatttaaaagataatccactattacaacggccattgaaggccagtgacgttaaggttcatccaattggtcactgggggacgattgccggtcaaaactttatctatgctcatcttaaccgggtcatcaacaagtacggtttgaagatgttctacgttgaaggtccaggtcatggtggtcaagtgatggtttcaaactcttaccttgacggtacttacaccgatatttatccagaaattacgcaggatgttgaagggatgcaaaagctcttcaagcaattctcattcccaggtggggttgcttcccatgcggcacctgaaacacccggttcaatccacgaaggtggcgaacttggttactcaatttcacacggggttggggcaattcttgacaatcctgacgaaatcgccgcggttgttgttggtgatggggaatccgaaacgggtccattagcaacttcatggcaatcaacgaagttcattaacccaatcaacgacggggctgttttaccaatcttgaacttaaatggttttaagatttctaatccaacgatttttggtcggacttctgatgctaagattaaggaatacttcgaaagcatgaattgggaaccaatcttcgttgaaggtgacgatcctgaaaaggttcacccagccttagctaaggccatggatgaagccgttgaaaagatcaaggcaatccagaagcatgctcgcgaaaataacgatgcaacattgccagtatggccaatgatcgtcttccgcgcacctaagggctggactggtccgaagtcatgggacggtgataagatcgaaggttcattccgtgctcatcaaattccgattcctgttgatcaaaatgacatggaacatgcggatgctttagttgattggctcgaatcatatcaaccaaaagaactcttcaatgaagatggctctttgaaggatgatattaaagaaattattcctactggggacagtcggatggctgctaacccaatcaccaatggtggggtcgatccgaaagccttgaacttaccaaacttccgtgattatgcggtcgatacgtccaaagaaggcgcgaatgttaagcaagatatgatcgtttggtcagactatttgcgggatgtcatcaagaaaaatcctgataacttccggttgttcggacctgatgaaaccatgtctaaccgtttatatggtgtcttcgaaaccactaatcgtcaatggatggaagacattcatccagatagtgaccaatatgaagcaccagctggccgggtcttagatgctcagttatctgaacaccaagctgaaggttggttagaaggttacgtcttaactggacgtcatgggttatttgccagttatgaagccttcctacgcgttgtggactcaatgttgacgcaacacttcaagtggttacgtaaagccaatgaacttgattggcgtaaaaagtacccatcacttaacattatcgcggcttcaactgtattccaacaagaccataatggttatacccaccaagatccaggtgcattaactcatttggccgaaaagaaaccagaatacattcgtgaatatttaccagccgatgccaacacgttattagctgtcggtgacgtcattttccggagccaagaaaagatcaactacgtggttacgtcaaaacacccacgtcaacaatggttcagcattgaagaagctaagcaattagttgacaatggtcttggtatcattgattgggcaagtacggaccaaggtagcgaaccagacattgtctttgcagctgctgggacggaaccaacgcttgaaacgttggctgccatccaattactacacgacagtttcccagagatgaagattcgtttcgtgaacgtggtcgacatcttgaagttacgtagtcctgaaaaggatccgcggggcttgtcagatgctgagtttgaccattactttactaaggacaaaccagtggtctttgctttccacggttacgaagacttagttcgtgacatcttctttgatcgtcacaaccataacttatacgtccacggttaccgtgaaaatggtgatattaccacaccattcgacgtacgggtcatgaaccagatggaccgcttcgacttagctaagtcggcaattgcggcgcaaccagcaatggaaaacactggtgcggccttcgttcaatccatggataatatgcttgctaaacacaatgcctatatccgggatgccggaactgacttgccagaagttaatgattggcaatggaagggtttaaaataattaattaatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcgggcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaattaagctaatccttgggctgctgtaataatcgcaaccttataaacgtcttcttcactgcatccacgtgacaagtcggagaccggcttgttcaggccttgcaagacaggacccaccgcttcaaaatgaccaaatcgttgcgcaatcttatagccaatattaccagactgaagctctggaaatacaaagacattggcatgaccagctactttggaaccaggagccttttgcaaaccaactttttcaacgaaggccgcgtcaaattgaagttcaccatcgatagccaattccggttcagcagcttgcgccttggccgttgcttcttgcactttagtgaccatttcacccttagccgaacccttagttgagaagctgagcatcgcaactttcgggtcaatatcgaagaccttagcagtagccgcactctgagtggcaatttccgctaacgtatcggcatcgggatcaatattgatggcacagtcagcaaagacgtagcgttcctcacccttttgcatgataaatgcacccgagattcggtgtgaaccgggcttggtcttaataatttgtaacgctggccgtaccgtatcaccagttggatggattgcacctgaaaccatcccatccgctttgcccatataaacgagcatcgtgccaaagtagttttcatcttccagcattttagccgcttgttctggcgtattcttacctttccgccgttcaacgagggcatcaagcattgcttgcttatcttcagccgggtatgtcgcaggatcaaggacttgaacgcctgttaaatccgcattcaaatcgttagccacagcctgaactttgtccgttgcacctaaaacaatcggcttaaccaagccgtctgcagctaatcgcgctgccgcaccgacaattcggggttcagttccttcagggaaaacaattgtttgatctttaccagtaattttttgtgctaatgactcaaataaatccatcctcagcgagatagttgattgtatgcttggtatagcttgaaatattgtgcagaaaaagaaacaaggaagaaagggaacgagaacaatgacgaggaaacaaaagattaataattgcaggtctatttatacttgatagcaagacagcaaacttttttttatttcaaattcaagtaactggaaggaaggccgtataccgttgctcattagagagtagtgtgcgtgaatgaaggaaggaaaaagtttcgtgtgcttcgagatacccctcatcagctctggaacaacgacatctgttggtgctgtctttgtcgttaattttttcctttagtgtcttccatcatttttttgtcattgcggatatggtgagacaacaacgggggagagagaaaagaaaaaaaaagaaaagaagttgcatgcgcctattattacttcaatagatggcaaatggaaaaagggtagtgaaacttcgatatgatgatggctatcaagtctagggctacagtattagttcgttatgtaccaccatcaatgaggcagtgtaattggtgtagtcttgtttagcccattatgtcttgtctggtatctgttctattgtatatctcccctccgccacctacatgttagggagaccaacgaaggtattataggaatcccgatgtatgggtttggttgccagaaaag

SEQ ID NO: 576 - DNA, 29 bp, Artificial sequence
  primer FBAp-F
ctacaatcaacagatcgcttcaattacgc

SEQ ID NO: 577 - DNA, 36 bp, Artificial sequence
  Primer oBP821
aattgtttaaactaagcgaatttcttatgatttatg

SEQ ID NO: 578 - DNA, 34 bp, Artificial sequence; identical to SEQ ID NO: 544
  Primer oBP484

SEQ ID NO: 579 - DNA, 37 bp, Artificial sequence
  oBP822
aattgcggccgcgtgcctcatctatatttctgaaatc

SEQ ID NO: 580 - DNA, 37 bp, Artificial sequence
  Primer oBP823
aattttaattaatcagctcttgttttgttctgcaaat

SEQ ID NO: 581 - DNA, 1647 bp, Artificial sequence
  kivD coding region from Listeria grayi codon optimized for expression in Saccharomyces cerevisiae
atgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaa

SEQ ID NO: 582 - DNA, 36 bp, Artificial sequence
  Primer oBP828
aattgtttaaacatgtataccgtaggacagtacttg

SEQ ID NO: 583 - DNA, 35 bp, Artificial sequence
  Primer oBP829
aattgtttaaacttaagagttttgcttagataagg

SEQ ID NO: 584 - DNA, 60 bp, Artificial sequence
  Primer oBP830
tatttaataataaaaatcataaatcataagaaattcgcttaagagttttgcttagataag

SEQ ID NO: 585 - DNA, 23 bp, Artificial
  AK109-1
agtcacatcaagatcgtttatgg

SEQ ID NO: 586 - DNA, 23 bp, Artificial
  AK109-2
gcacggaatatgggactacttcg

SEQ ID NO: 587 - DNA, 23 bp, Artificial
  AK109-3
actccacttcaagtaagagtttg

SEQ ID NO: 588 - DNA, 20 bp, Artificial
  LA135
cttggcagcaacaggactag

SEQ ID NO: 589 - DNA, 23 bp, Artificial
  BP461
ttcttggagctgggacatgtttg

SEQ ID NO: 590 - DNA, 22 bp, Artificial
  LA92
gagaagatgcggccagcaaaac

SEQ ID NO: 591 - DNA, 4242 bp, Artificial
  pLA59
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcaatgcggatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 592 - DNA, 80 bp, Artificial
  LA678
caacgttaacaccgttttcggtttgccaggtgacttcaacttgtccttgtgcattgcggattacgtattctaatgttcag

SEQ ID NO: 593 - DNA, 81 bp, Artificial
  LA679
gtggagcatcgaagactggcaacatgatttcaatcattctgatcttagagcaccttggctaactcgttgtatcatcactgg

SEQ ID NO: 594 - DNA, 23 bp, Artificial
  LA337
ctcatttgaatcagcttatggtg

SEQ ID NO: 595 - DNA, 24 bp, Artificial
  LA692
ggaagtcattgacaccatcttggc

SEQ ID NO: 596 - DNA, 24 bp, Artificial
  LA693
agaagctgggacagcagcgttagc

SEQ ID NO: 597 - DNA, 7523 bp, Artificial; identical to SEQ ID NO: 480
  pLA34

SEQ ID NO: 598 - DNA, 96 bp, Artificial
  LA722
tgccaattatttacctaaacatctataaccttcaaaagtaaaaaaatacacaaacgttgaatcatcaccttggctaactcgttgtatcatcactgg

SEQ ID NO: 599 - DNA, 80 bp, Artificial
  LA733
cataatcaatctcaaagagaacaacacaatacaataacaagaagaacaaagcattgcggattacgtattctaatgttcag

SEQ ID NO: 600 - DNA, 30 bp, Artificial
  LA453
caccgaagaagaatgcaaaaatttcagctc

SEQ ID NO: 601 - DNA, 25 bp, Artificial
  LA694
gctgaagttgttagaactgttgttg

SEQ ID NO: 602 - DNA, 21 bp, Artificial
  LA695
tgttagctggagtagacttgg

SEQ ID NO: 603 - DNA, 31 bp, Artificial
  LA811
aacgaagcatctgtgcttcattttgtagaac

SEQ ID NO: 604 - DNA, 59 bp, Artificial
  LA817
cgatccacttgtatatttggatgaatttttgaggaattctgaaccagtcctaaaacgag

SEQ ID NO: 605 - DNA, 31 bp, Artificial
  LA812
aacaaagatatgctattgaagtgcaagatgg

SEQ ID NO: 606 - DNA, 33 bp, Artificial
  LA818
ctcaaaaattcatccaaatatacaagtggatcg

SEQ ID NO: 607 - DNA, 29 bp, Artificial
  LA516
ctcgaaacaataagacgacgatggctctg

SEQ ID NO: 608 - DNA, 30 bp, Artificial
  LA514
cactatctggtgcaaacttggcaccggaag

SEQ ID NO: 609 - DNA, 29 bp, Artificial
  LA515
tgtttgtagccactcgtgaacttctctgc

SEQ ID NO: 610 - DNA, 5091 bp, Artificial Sequence
  P[TEF(M4)]-xpk1+P[ENO1]-eutD
gaattcggtcattgatgcatgcatgtgccgtgaagcgggacaaccagaaaagtcgtctataaatgccggcacgtgcgatcatcgtggcggggttttaagagtgcatatcacaaattgtcgcattaccgcggaaccgccagatattcattacttgacgcaaaagcgtttgaaataatgacgaaaaagaaggaagaaaaaaaaagaaaaataccgcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagctgaggatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtactagttctagagcggccgcccgcaaattaaagccttcgagcgtcccaaaaccttctcaagcaaggttttcagtataatgttacatgcgtacacgcgtttgtacagaaaaaaaagaaaaatttgaaatataaataacgttcttaatactaacataactattaaaaaaaataaatagggacctagacttcaggttgtctaactccttccttttcggttagagcggatgtgggaggagggcgtgaatgtaagcgtgacataactaattacatgattaattaattattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctaccttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcacgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataaacggttagacatggtttcatcaggtccgaacaaccggaagttatcaggatttttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgttgcatcgttattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttggattagaaatcttaaaaccatttaagttcaagattggtaaaacagccccgtcgttgattgggttaatgaacttcgttgattgccatgaagttgctaatggacccgtttcggattccccatcaccaacaacaaccgcggcgatttcgtcaggattgtcaagaattgccccaaccccgtgtgaaattgagtaaccaagttcgccaccttcgtggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatcctcagctggaacttagattagattgctatgctttctctctaacgagcaagaagtaaaaaaagttgtaatagaacaagaaaaatgaaactgaagcttgagaaattgaagaccgtttattagcttaaatatcaatgggaggtcatcgaaagagaaaaaaatcaagaaagaaactctcaagaaaaagaaacgtgataaaaatttttattgcctctctcgacgaagagaaagaaacgaggcggtcccttttttcttttccaaacctttagtacgggtaattagcgacaccctagaggaagaaagaggggaaatttagtatgctgtgcttgggtgtcttgaagtggtacggcgatgcgcggagtccgagaaaatctggaagagtaaaaagggggtagaagcgttttgaagctat

SEQ ID NO: 611 - DNA, 36 bp, Artificial Sequence
  oBP962
aattgaattcggtcattgatgcatgcatgtgccgtg

SEQ ID NO: 612 - DNA, 37 bp, Artificial Sequence
  oBP963
aattgaattcatagcttcaaaacgcttctaccccctt

SEQ ID NO: 613 - DNA, 83 bp, Artificial Sequence
  oBP988
acttctttcacataatcaatctcaaagagaacaacacaatacaataacaagaagaacaaagcggattacgtattctaatgttc

SEQ ID NO: 614 - DNA, 82 bp, Artificial Sequence
  oBP989
ataaccttcaaaagtaaaaaaatacacaaacgttgaatcatgagttttatgttaattagcatagcttcaaaacgcttctacc

SEQ ID NO: 615 - DNA, 6728 bp, Artificial Sequence
  pJT254
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaatgtccaatttactgcccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaggagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtgttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 616 - DNA, 37 bp, Artificial Sequence
  oBP880
aattggccggccgcattgcggattacgtattctaatg

SEQ ID NO: 617 - DNA, 38 bp, Artificial Sequence
  oBP881
aattgcggccgccaccttggctaactcgttgtatcatc

SEQ ID NO: 618 - DNA, 4285 bp, Artificial Sequence
  pBP2234
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcttaattaatctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 619 - DNA, 40 bp, Artificial Sequence
  oBP1167
aattgtttaaacaaaatgaaggccaaatcaaggcgggaag

SEQ ID NO: 620 - DNA, 41 bp, Artificial Sequence
  oBP1168
aattggccggccgtttatcttgcacatcacatcagcggaac

SEQ ID NO: 621 - DNA, 11856 bp, Artificial Sequence
  pYZ090
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcgctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggcagttacaatgtattatgaagatgatgtagaagtatcagcacttgctggaaagcaaattgcagtaatcggttatggttcacaaggacatgctcacgcacagaatttgcgtgattctggtcacaacgttatcattggtgtgcgccacggaaaatcttttgataaagcaaaagaagatggctttgaaacatttgaagtaggagaagcagtagctaaagctgatgttattatggttttggcaccagatgaacttcaacaatccatttatgaagaggacatcaaaccaaacttgaaagcaggttcagcacttggttttgctcacggatttaatatccattttggctatattaaagtaccagaagacgttgacgtctttatggttgcgcctaaggctccaggtcaccttgtccgtcggacttatactgaaggttttggtacaccagctttgtttgtttcacaccaaaatgcaagtggtcatgcgcgtgaaatcgcaatggattgggccaaaggaattggttgtgctcgagtgggaattattgaaacaacttttaaagaagaaacagaagaagatttgtttggagaacaagctgttctatgtggaggtttgacagcacttgttgaagccggttttgaaacactgacagaagctggatacgctggcgaattggcttactttgaagttttgcacgaaatgaaattgattgttgacctcatgtatgaaggtggttttactaaaatgcgtcaatccatctcaaatactgctgagtttggcgattatgtgactggtccacggattattactgacgaagttaaaaagaatatgaagcttgttttggctgatattcaatctggaaaatttgctcaagatttcgttgatgacttcaaagcggggcgtccaaaattaatagcctatcgcgaagctgcaaaaaatcttgaaattgaaaaaattggggcagagctacgtcaagcaatgccattcacacaatctggtgatgacgatgcctttaaaatctatcagtaaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 622 - DNA, 37 bp, Artificial Sequence
  oBP1169
atgcttaattaaatgttgacaaaagcaacaaaagaac

SEQ ID NO: 623 - DNA, 35 bp, Artificial Sequence
  oBP1170
aattgtcgacctagagagctttcgttttcatgagt

SEQ ID NO: 624 - DNA, 37 bp, Artificial Sequence
  oBP1165
aattgcggccgcagacagggttactactaactacaac

SEQ ID NO: 625 - DNA, 37 bp, Artificial Sequence
  oBP1166
atgcttaattaagattgtttaactcagatgtaaattt

SEQ ID NO: 626 - DNA, 7595 bp, Artificial Sequence
  pBP2640
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcagacagggttactactaactacaaccctcatactgccttacgtagccaaacaagagcagttctcagattacaatgggagatcatttgaaaatatcaaagattgatcaagaatattttactggtggcatccgcccgccctttaatttcggaatttagtgctgcttacaactcttcattttcctcatgcgggacgccagctttggtgcgggatgaaggcaatatccaaaccagcatcaggaaaagcctgaagaaatgtggtgcctaatgctcttatctaatctgtatccacaccttacagcgaagtgttcaattaactgtgcggctaattctgacacttcatcaaaaattacaccggtatatcaaatggcggtgtagtttgaaaagtacactgtatgtccattaataaaattacgccgaagaacactgactagctataaattctcttccggcgtccaatttcaacctaaggcaagtattgttaatcaataatgcgtgttggtaaatatgaagcccgatgttgattaagaagaattattcgtataagaattaagcaagcaaaattaaggaaaattttttctttcctattcgtcatcgcagacagccttcatcttctcgagataacacctggaggaggagcaatgaaatgaaaggaaaaaaaaatactttctttttcttgaaaaaagaaaaaaattgtaagatgagctattcgcggaacattctagctcgtttgcatcttcttgcatttggtaggttttcaatagttcggtaatattaacggatacctactattatcccctagtaggctcttttcacggagaaattcgggagtgttttttttccgtgcgcattttcttagctatattcttccagcttcgcctgctgcccggtcatcgttcctgtcacgtagtttttccggattcgtccggctcatataataccgcaataaacacggaatatctcgttccgcggattcggttaaactctcggtcgcggattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcttaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 627 - DNA, 37 bp, Artificial Sequence
  oBP1163
aattgcggccgctaatctcttgtagtgtaggatcaac

SEQ ID NO: 628 - DNA, 37 bp, Artificial Sequence
  oBP1164
atgcttaattaagattttacgtatatcaactagttga

SEQ ID NO: 629 - DNA, 8290 bp, Artificial Sequence
  pBP2641
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgctaatctcttgtagtgtaggatcaactattttcgcatacttgcaatgttcagcattgcaccatttcaaattttaatattaatattaatcgttttcgttcatatgttcattcatagtttacaaataatgcaatcatatgcagagatattttgtccgtggttaatagggctgcctgttattcctttaattcaactaaattacatacgtctaataatatcaaaaattttgacgtttttgttttttttctttattttaagtaagaccaaaccaggggagaaagggttgctacgcctaacaacaagaacttgtatatcgtttcttgttacttatacttttctgcccacttctctcttagaattgctcgagctcatccttggtaataaaacagtgaggacggttactcgaggtttcaacaggggaaaataaatttatatgatgaatcaagagccccgttcttttaccgtattctctttcatactacatactagggaaagaactgaaaactccgctacctgctgtaacagcgcataataaaaagcaagaatatagacagttactgttgtttacgttctttgatgacatcattctcatcagacatacagaaacacatcctttttgtctaccccgtatttattccaacttcaaagtataggtaccgtccggttatactctcatatactttgtggcagttcgcttctttaaaccttgttaacccagaatattttcagtgcaaaaagcttccgatcctcaaatacagtgagaaaaaaagcaaacttgtcttcattatttttctgtttggccctgtcacggttctttttatggccttctcgaaggatatccgtagtcgattatattcacgtagttgccaaaagtaatttttggaaaaactattattcctccgagaaaacctcacacagaaatccttgcaggtcccatctggaatataattcccccctcctgaagcaaaatttttcctttgagccggaatttttgatattccgagttctttttttccattcgcggaggttattccattcctaaacgagtggccacaatgaaacttcaattcatatcgaccgactatttttctccgaaccaaaaaaatagcagggcgagattggtgctgcggaaaaaagaggaaaaatttttttcgtagttttcttgtgcaaattagggtgtaaggtttttagggcttattggcaagcagaagagacgacaattataggtcttaaattcaaggcggatgtaaggagtattggtttcgaaagtttttccgaagcggcatggcagggactgcttgcgcatgcgctcggattatcttcatttttgattgcaaaaacgtagaatcatggtaaattacatgaagaattctcttttttttttttttttttttttttttacctctaaagagtgttgaccaactgaaaaaacccttcttcaagagagttaaactaagactaaccatcataacttccaaggaattaatcgatatcttgcactcctgatttttcttcaaagagacagcgcaaaggattatgacactgttgcattgagtcaaaagtttttccgaagtgacccagtgctcttttttttttttccgtgaaggactgacaaatatgcgcacaagatccaatacgtaatggaaattcggaaaaactaggaagaaatgctgcagggcattgccgtgccgatcttttgtctttcagatatatgagaaaaagaatattcatcaagtgctgatagaagaataccactcatatgacgtgggcagaagacagcaaacgtaaacatgagctgctgcgacatttgatggcttttatccgacaagccaggaaactccaccattatctaatgtagcaaaatatttcttaacacccgaagttgcgtgtccccctcacgtttttaatcatttgaattagtatattgaaattatatataaaggcaacaatgtccccataatcaattccatctggggtctcatgttctttccccaccttaaaatctataaagatatcataatcgtcaactagttgatatacgtaaaatcttaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 630 - DNA, 35 bp, Artificial Sequence
  oBP1205
ttaactcgaggcgatttaatctctaattattagtt

SEQ ID NO: 631 - DNA, 35 bp, Artificial Sequence
  oBP1206
ttaagtcgactccttggttccactaattcatcggt

SEQ ID NO: 632 - DNA, 7862 bp, Artificial Sequence
  pBP2662
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcagacagggttactactaactacaaccctcatactgccttacgtagccaaacaagagcagttctcagattacaatgggagatcatttgaaaatatcaaagattgatcaagaatattttactggtggcatccgcccgccctttaatttcggaatttagtgctgcttacaactcttcattttcctcatgcgggacgccagctttggtgcgggatgaaggcaatatccaaaccagcatcaggaaaagcctgaagaaatgtggtgcctaatgctcttatctaatctgtatccacaccttacagcgaagtgttcaattaactgtgcggctaattctgacacttcatcaaaaattacaccggtatatcaaatggcggtgtagtttgaaaagtacactgtatgtccattaataaaattacgccgaagaacactgactagctataaattctcttccggcgtccaatttcaacctaaggcaagtattgttaatcaataatgcgtgttggtaaatatgaagcccgatgttgattaagaagaattattcgtataagaattaagcaagcaaaattaaggaaaattttttctttcctattcgtcatcgcagacagccttcatcttctcgagataacacctggaggaggagcaatgaaatgaaaggaaaaaaaaatactttctttttcttgaaaaaagaaaaaaattgtaagatgagctattcgcggaacattctagctcgtttgcatcttcttgcatttggtaggttttcaatagttcggtaatattaacggatacctactattatcccctagtaggctcttttcacggagaaattcgggagtgttttttttccgtgcgcattttcttagctatattcttccagcttcgcctgctgcccggtcatcgttcctgtcacgtagtttttccggattcgtccggctcatataataccgcaataaacacggaatatctcgttccgcggattcggttaaactctcggtcgcggattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcttaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 633 - DNA, 37 bp, Artificial Sequence
  oBP1211
aattgcggccgctttatgctgcaaaggtcctaatgta

SEQ ID NO: 634 - DNA, 37 bp, Artificial Sequence
  oBP1212
aattttaattaagttttagtgtgtgaatgaaataggt

SEQ ID NO: 635 - DNA, 7414 bp, Artificial Sequence
  pBP2666
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgctttatgctgcaaaggtcctaatgtataaggaaagaatatttagagaaaagaagaaaacaagagttttatatacatacagagcacatgcatgccatatgatcatgtgttgtcgcacacatatatatatgcctgtatgtgtcagcactaaagttgcctggccatccacgctatatatacacgcctggcggatctgctcgaggattgcctacgcgtgggcttgatccaccaaccaacgctcgccaaatgaactggcgctttggtcttctgccatcgtccgtaaaccccggccaaagagaccggaaagatcggtgaaaacatcttgatcttgctcccgggaattttagattcaggtaggaaattgattacatcaatactgttaccctgaatcatattcgacgatgtcgtctcacacggaaatataattcatttcttggttttccaaaaaaattttcattttttttcacttttttgtttcgtcctcctttttttttttttttttttattttttttcctgtgttcacttttttttttttcagtttacatctttctgcattcttttctgtgtttttttttttttttttcgtttttccattgttcgttcgttgcctgttttttcgccctattgttctcgagcctaaaaattttttcctttcctgctttcctttcttcgttcaaagtttcctattccattgttctctttggtaaactcattgttgtcggaactcagatatattcaggtcaatttactgtacttcaattgacttttttcttgaaatttcaacttgccttttcaacttgttcttcttttttaatcttattctacactttagttcccttaccttgttcctaattattgtctagcaaaaagaaaacatacacctatttcattcacacactaaaacttaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 636 - DNA, 40 bp, Artificial Sequence
  HY183
ggaagcggccgcctggagacatagactacgaaaatctttt

SEQ ID NO: 637 - DNA, 40 bp, Artificial Sequence
  HY184
ggccttaattaattttaattattgtagtacttgttgaaag

SEQ ID NO: 638 - DNA, 7712 bp, Artificial Sequence
  pBP2728
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcctggagacatagactacgaaaatcttttagtcaaatttacaagggcgagtagcttttaattgtgccttcatgtgccaagtaaattgcgtacaaaaagtgtcaagagattttctcattccctacatttgccagttctataggcaccttcttgcgcatatacatatctacaaatatcccggcttatttccagtattactatgttttactcttaattcaaataagcactgctattattacttttgatcacgtcaaaagatacaaaagacaatctacaagtttatggccttgcattgtttataatttatgtgctatctgagcatacccgccttttctctattgttattcgagagaagactaaaaatatctgctgcaagaacaaaaatgggaactgcttgtctcttaaaattatcaatccacaatggaaatagactttttttacacagcaacggtttttgaatgctatgaaacggtcattatcagctaacacgctcaacactttactccatcttcttaaagggtgtaaacagaacgataaatgatttccataaatagtaaggcccagccgacagcctgcagcgcaaaagtgaaccgtttccatctaacttggataatctgcattgttcccaacgaatgacagaatccatcgccagatctaataaggttcaattttctctatacgacggctataaaaggaagttttccgagcgcgcttcgaagcagaatagggaggaccccagacccgttttagtgcctgtccctttttagtacgtgtttccgtttccgtgcctggctagatccatctttcttcgcgcgtttattttcagcaccatgttttaggtttttacagcatcgtttaaggaacccaacaatacaatagcgggaagaatgcactttctcgttccataaagggtctctttcacctatacggttggtacagatttccagtgtatgccagtcagccacggcattacgtcgtttgcttctattttcttcgttttgaactgcgtttgtatgcaactgtcccttgacagagaaaaaagtgaagcaaaatgacagacaaagaaatcttttgtataaaaggtcggttgaatcttgttgttagcttgaaatcagcttgcttttctcctctaaattacataaaaaaccaagaaaatatcagactttttcattcgctttcaacaagtactacaataattaaaattaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 639 - DNA, 40 bp, Artificial Sequence
  HY185
ggaagcggccgcccgtatctaacgtaataaacgatatcta

SEQ ID NO: 640 - DNA, 40 bp, Artificial Sequence
  HY186
ggccttaattaactttatgtgtatttaattgtgttcgaag

SEQ ID NO: 641 - DNA, 7610 bp, Artificial Sequence
  pBP2730
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcccgtatctaacgtaataaacgatatctattttcgaggcgctcgacatctcgtatctgggacagaaagtgaggtagattattcaagaatacctattaagaaaggtagaaggtattgcaccgattcctagtatcaattcttttcaaaaccacttattttgcaaaacatgcgtctaacctgccatttcagcaacgtaaataataattacttccatatatattcttctcccccagtagcaattttgacatgacaaatttcagcgatagttgcttcggcattcgaaaatcgtagaagtatgtcttaatgtagaaggttgagaacaaccggatcttgcggtcatttttcttttcgaggaaagtgcaagtctgccactttccagaaggcatagccttgcccttttgttgatatttctccccaccgtaattgttgcattcgcgatcttttcaacaatacattttatcatcaagcccgcaaatcctctggagtttgtcctctcgttcactgttgggaaaaacaatacgcctaattcgtgattaagattcttcaaaccatttcctgcggagtttttactgtgtgttgaacggttcacagcgtaaaaaaaagttactataggcacggtattttaatttcaattgtttagaaagtgccttcacaccattagcccctgggattaccgtcataggcactttctgctgagctcctgcgagatttttgcgctgaaagagtaaaagaaatctttcacagcggctccgcgggcccttctacttttaaacgagtcgcaggaacagaagccaaatttcaaagaacgctacgctttcgccgtttctggttctcccaccaataacgctccagcttgaacaaagcataagactgcaaccaaagcgctgacggacgatccgaagataaagcttgctttgcccattgttctcgtttcgaaaggctatataaggacacggattttcctttttttttccacctattgtctttctttgttaagcttttattctccgggttttttttttgagcatatcgaaagctttcttttcgcaaatcaaacatagcaaaccgaactcttcgaacacaattaaatacacataaagttaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 642 - DNA, 40 bp, Artificial Sequence
  HY187
ggaagcggccgcaacctctccgcccgtatattttttttaa

SEQ ID NO: 643 - DNA, 40 bp, Artificial Sequence
  HY188
ggccttaattaatttcgtttgtaatctagcaggatacact

SEQ ID NO: 644 - DNA, 6964 bp, Artificial Sequence
  pBP2732
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcaacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaattaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 645 - DNA, 9613 bp, Artificial Sequence
  pHR81-ILV5p-K9JB
aaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctccgcggtgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatctcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagtcaccggtggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgttt

SEQ ID NO: 646 - DNA, 13022 bp, Artificial Sequence
  pLA84
ccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctaggggccgtgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtggccggcttcacatacgttgcatacgtcgatatagataataatgataatgacagcaggattatcgtaatacgtaatagctgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaacacgtgagtatgactgacaaaaaaactcttaaagacttaagaaatcgtagttctgtttacgattcaatggttaaatcacctaatcgtgctatgttgcgtgcaactggtatgcaagatgaagactttgaaaaacctatcgtcggtgtcatttcaacttgggctgaaaacacaccttgtaatatccacttacatgactttggtaaactagccaaagtcggtgttaaggaagctggtgcttggccagttcagttcggaacaatcacggtttctgatggaatcgccatgggaacccaaggaatgcgtttctccttgacatctcgtgatattattgcagattctattgaagcagccatgggaggtcataatgcggatgcttttgtagccattggcggttgtgataaaaacatgcccggttctgttatcgctatggctaacatggatatcccagccatttttgcttacggcggaacaattgcacctggtaatttagacggcaaagatatcgatttagtctctgtctttgaaggtgtcggccattggaaccacggcgatatgaccaaagaagaagttaaagctttggaatgtaatgcttgtcccggtcctggaggctgcggtggtatgtatactgctaacacaatggcgacagctattgaagttttgggacttagccttccgggttcatcttctcacccggctgaatccgcagaaaagaaagcagatattgaagaagctggtcgcgctgttgtcaaaatgctcgaaatgggcttaaaaccttctgacattttaacgcgtgaagcttttgaagatgctattactgtaactatggctctgggaggttcaaccaactcaacccttcacctcttagctattgcccatgctgctaatgtggaattgacacttgatgatttcaatactttccaagaaaaagttcctcatttggctgatttgaaaccttctggtcaatatgtattccaagacctttacaaggtcggaggggtaccagcagttatgaaatatctccttaaaaatggcttccttcatggtgaccgtatcacttgtactggcaaaacagtcgctgaaaatttgaaggcttttgatgatttaacacctggtcaaaaggttattatgccgcttgaaaatcctaaacgtgaagatggtccgctcattattctccatggtaacttggctccagacggtgccgttgccaaagtttctggtgtaaaagtgcgtcgtcatgtcggtcctgctaaggtctttaattctgaagaagaagccattgaagctgtcttgaatgatgatattgttgatggtgatgttgttgtcgtacgttttgtaggaccaaagggcggtcctggtatgcctgaaatgctttccctttcatcaatgattgttggtaaagggcaaggtgaaaaagttgcccttctgacagatggccgcttctcaggtggtacttatggtcttgtcgtgggtcatatcgctcctgaagcacaagatggcggtccaatcgcctacctgcaaacaggagacatagtcactattgaccaagacactaaggaattacactttgatatctccgatgaagagttaaaacatcgtcaagagaccattgaattgccaccgctctattcacgcggtatccttggtaaatatgctcacatcgtttcgtctgcttctaggggagccgtaacagacttttggaagcctgaagaaactggcaaaaaatgttgtcctggttgctgtggttaagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgaggatccactagttctagagcggccgctctagaactagtaccacaggtgttgtcctctgaggacataaaatacacaccgagattcatcaactcattgctggagttagcatatctacaattgggtgaaatggggagcgatttgcaggcatttgctcggcatgccggtagaggtgtggtcaataagagcgacctcatgctatacctgagaaagcaacctgacctacaggaaagagttactcaagaataagaattttcgttttaaaacctaagagtcactttaaaatttgtatacacttattttttttataacttatttaataataaaaatcataaatcataagaaattcgcttactcttaattaatcaagcctccatcgaaatgatgacttttagtgcttgagtagacgcagcttggccaaaagtttcatatgcgtccaagatctggtccaggctgaatctatgtgttatcaatctagatggatctagcttgtgactttgaacagttttcagtaacatcggggtggtagccgtgtcaaccaaccttgtagtaatcgtgacattatgggaccataaactttcaagatgcaaatcaactttgctaccgtgaacgccgacattagcgatagttccaccgggagctacgatattctgacacaattcaaatgtagcaggtatcccaactgcttcaatcgcagtatcaacacctaagccttcagtaagagctttcacttcggctgcggcgttaccacccgtggagtttactgttctggtggcaccaaattgtttggctaatcccagcctgttatcatcaagatcgatcattatgatttcagctggggagtagaattgtgctgtcagtaaggcggccaaaccaacgggaccagcacctactatagccaccgaagaaccaggtgcgactttgccgtttaggactccgcactcaaaacccgttggtagaatatctgataacatgactaaggcctcttcatccgcacctgccggaatacgataaagggatgtgtcagcatgtggtactcttacgtactctgcttgggtaccatcaatttcgttgcccagaatccaacccccggtcgtacagtgactgaacattcctcttctacaaaatgagcactttccgcaactcgatatacatgatatcaaaactctatcgcctggttggaaagcagtaaccccagatccgactgattcaataacccccactccttcatgccctaatacacgaccgggtttacaagtcgcaacgtcacctttaagaatgtgtagatcggttccgcaaattgtagtctttgttaccttcactatagcgtcaccaggttccttaagctctggcttctgtctctcttccaccaacttctggcctgggcccctatacactaatgctttcatcctcagctagctattgtaatatgtgtgtttgtttggattattaagaagaataattacaaaaaaaattacaaaggaaggtaattacaacagaattaagaaaggacaagaaggaggaagagaatcagttcattatttcttctttgttatataacaaacccaagtagcgatttggccatacattaaaagttgagaaccaccctccctggcaacagccacaactcgttaccattgttcatcacgatcatgaaactcgctgtcagctgaaatttcacctcagtggatctctctttttattcttcatcgttccactaacctttttccatcagctggcagggaacggaaagtggaatcccatttagcgagcttcctcttttcttcaagaaaagacgaagcttgtgtgtgggtgcgcgcgctagtatctttccacattaagaaatataccataaaggttacttagacatcactatggctatatatatatatatatatatatgtaacttagcaccatcgcgcgtgcatcactgcatgtgttaaccgaaaagtttggcgaacacttcaccgacacggtcatttagatctgtcgtctgcattgcacgtcccttagccttaaatcctaggcgggagcattctcgtgtaattgtgcagcctgcgtagcaactcaacatagcgtagtctacccagtttttcaagggtttatcgttagaagattctcccttttcttcctgctcacaaatcttaaagtcatacattgcacgactaaatgcaagcgacgtcagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatcaagaaaaaacacaaagctttcaatcaatgaatcgaaaatgtcattaaaatagtatataaattgaaactaagtcataaagctataaaaagaaaatttatttaaatgcaagatttaaagtaaattcacggccctgcaggccttaagagttttgcttagataaggctaagccaatctgtctcaatgattctggcatatccatttgttccatatgaacttcaacgacatgtgctttttgaggagtagcatcgatagcagctaaagtattagcgaagtctgtttctgtgaaaacgttgtgagtgtcgacagtttcggcatcaccaccaaatgtttcagcaactaattgcaagttccaagttggtatatcattgtaactctcatcctctccatggatggctctttcgactgtatagccatcgttattgataatgaatatcactggtgtcaatttctctctgaagatggtggacatttcctgtgctgtcagttgaaaagatccatcaccgatggatagaatgtgtctcctttctggggcagcaatttgtgaaccaatcatagcaggtaatgtgtatcctatggagccccataatgtttgactgatcaaattcataccctttttcagaggtgccaacatcaaaccgaaagatgatgtcccctgctcagtgaccaacacatcatcagcttgcaaaaagttcataacagcttggtgaaatctgtcttgctttagtggtgtttcggcctgtggttcgaaaacagctaattcagcttgtttagcagcagtatcagcaaaagtaaagtttagtttttccagctctgccaaaagaccgttaagagaaatcccagagtaagtagacccatctggcagcataatgatgtcatttgcagcggttaaagtgttttcagtcttaaagccttgagaaaatgaggaggtagaattgtcaatgattttcccaccaaaatgtaaaacgaagtcactattgtcaacgtaatccagaacgtttttgtcagaaaaagctgggtaataggtaccaatgaaatgttcgttctcttcattgaaagagcctttgccatatgccaaattggttactggcaactttgtttggtttatccagttttcaaatctttctcttatctggaaacgggcgatctcatgaccggcgattacgataggttgagcggccttttctaagtgtgatagtatgatttctgcaagttgtgcctctctctcaccagatgatttctctgtttgtagtgcttttgcaggtttaactattgctttatgagctatatcaattggaagattgatgtatactggcctcttttccaacaaggctgtttctaatactctgtcgatctctgaagctgcattctcttcagtaagcatggttgtagcggcagtgacttccttagccatttcactaaagttatgaaagttacccattcctaaggaatgatgaaccagctttttgttggattgcacattcatagttggagaacccacgatgtggatgacagggacttgttctgcaaaactaccagctgttccgttaatggctgacagttcacccactccgaatgtagtaacaagagctgatacgcctctttcacgggcgtagccatctgctgcatatgctgcgtttagttcattagtattcccttgccaggaaagtccttcgtgattttgaatgtaatctagaaaagtcaaattgtaatcccctggcacaccgaaaaccttatcgataccaatctcttctagtctatctaccaagtactgtcctacggtatacattttgtttactagtttatgtgtgtttattcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattggagct

SEQ ID NO: 647 - DNA, 75 bp, Artificial Sequence
  oBP1204
tacataaaaatgcttataaaactttaactaataattagagattaaatcgcctagagagctttcgttttcatgagt

SEQ ID NO: 648 - skipped

SEQ ID NO: 649 - DNA, 6903 bp, Artificial Sequence
  pLA71
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcgatctgaaatgaataacaatactgacagtagatctgaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaatctagagctgaggatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctagttaattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttaggttttgggacgctcgaaggctttaatttggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 650 - DNA, 90 bp, Artificial Sequence
  895
tctcaattattattttctactcataacctcacgcaaaataacacagtcaaatcaatcaaaatgttgacaaaagcaacaaaagaacaaaaa

SEQ ID NO: 651 - DNA, 81 bp, Artificial Sequence; identical to SEQ ID NO: 593
  679

SEQ ID NO: 652 - DNA, 80 bp, Artificial Sequence
  N1341
gttgcaagaaatgcattatgcaattttttgattatgacaatctctcgaaaatagcttcaaaacgcttctacccccttttt

SEQ ID NO: 653 - DNA, 80 bp, Artificial Sequence
  N1338
catacattatacgaacggtactgaacattagaatacgtaatccgcaatgcccgcaaattaaagccttcgagcgtcccaaa

SEQ ID NO: 654 - DNA, 30 bp, Artificial Sequence
  N1033c
gcattgcggattacgtattctaatgttcag

SEQ ID NO: 655 - DNA, 81 bp, Artificial Sequence
  N1342
acatatgtgaaaaaaaatagttgatattttaaaccaaatcagaaatttatcaccttggctaactcgttgtatcatcactgg

SEQ ID NO: 656 - DNA, 30 bp, Artificial Sequence
  N1364
atgacaacagattactcatcaccagcatat

SEQ ID NO: 657 - DNA, 604 bp, Artificial Sequence
  FBA promoter variant L8
gcctacttggcttcacatacgttgcatacgacgatatagaaaataatgataatgacagcaggattatcgtataacgtaatagtcgaaaaatctcaaaaatctgtgggtcattacgtaaataatgataggaatgtgattcttctatttttcctttttccattctggcagccgtcgggaaaacgtggcttcctctctttcgggctctattggagtaacgctgccgtgagcttcctctctttccatatctaacaactgagcacgtaaccaatggtaaagcatgagcttagcgttgctccaaagaagtattggaaggttaataccatgtgtctgttctcttctgactttgactcctcaaataaaaaaaaattctacaatcaacagatcgcttcaattacgctctcacaaaaacttttttccttcttcttcgcccacgttaaattttaaccctcatgctgtctaacggatttctgcacttaatttattataaaacgacaaagacataatacttctctatcaatttcagttattgttcttcattgcattactcttctgttcttctttttcatttgtcatatacaaccataaccaaataatacatattcaa

SEQ ID NO: 658 - DNA, 80 bp, Artificial Sequence
  N1366
gttgcaagaaatgcattatgcaattttttgattatgacaatctctcgaaagcctacttggcttcacatacgttgcatacg

SEQ ID NO: 659 - DNA, 65 bp, Artificial Sequence
  N1368
atatgctggtgatgagtaatctgttgtcattttgaatatgtattatttggttatggttgtatatg

SEQ ID NO: 660 - DNA, 80 bp, Artificial Sequence
  N1371
aaaaactaatacgtaaacctgcattaaggtaagattatatcagaaaatgtgttgcaagaaatgcattatgcaattttttg

SEQ ID NO: 661 - DNA, 85 bp, Artificial Sequence
  N1372
tagaagctaatctttaacctggaagacaggacagaaaagtaattacaagaacatatgtgaaaaaaaatagttgatattttaaacc

SEQ ID NO: 662 - DNA, 25 bp, Artificial Sequence
  BK93
aaaaattgattctcatcgtaaatgc

SEQ ID NO: 663 - skipped

SEQ ID NO: 664 - protein, 549 aa, Saccharomyces cerevisiae
MKLERVSSNGSFKRGRDIQSLESPCTRPLKKMSPSPSFTSLKMEKPFKDIVRKYGGHLHQSSYNPGSSKVELVRPDLSLKTDQSFLQSSVQTTPNKKSCNEYLSTPEATPLKNTATENAWATSRVVSASSLSIVTPTEIKNILVDEFSELKLGQPLTAQHQRSHAVFEIPEIVENIIKMIVSLESANIPKERPCLRRNPQSYEHSLLMYKDEERAKKAWSAAQQLRDPPLVGHKEKKQGALFSCMMVNRLWLNVTRPFLFKSLHFKSVHNFKEFLRTSQETTQVMRPSHFILHKLHQVTQPDIERLSRMECQNLKWLEFYVCPRITPPLSWFDNLHKLEKLIIPGNKNIDDNFLLRLSQSIPNLKHLVLRACDNVSDSGVVCIALNCPKLKTFNIGRHRRGNLITSVSLVALGKYTQVETVGFAGCDVDDAGIWEFARLNGKNVERLSLNSCRLLTDYSLPILFALNSFPNLAVLEIRNLDKITDVRHFVKYNLWKKSLDAPILIEACERITKLIDQEENRVKRINSLVALKDMTAWVNADDEIENNVD

SEQ ID NO: 665 - skipped

SEQ ID NO: 666 - DNA, 1650 bp, Saccharomyces cerevisiae
atgaagctggagcgcgtgagttctaacgggagctttaagcgtggccgtgacatccaaagtttggagagtccgtgtacccgcccattaaagaaaatgtcgccatcaccttcatttacgagcctgaagatggaaaaaccgtttaaggacattgttcgaaaatacgggggtcacctgcaccagtcctcgtataacccaggttcttcaaaagttgaactcgtgcgtccggacctgagcttgaaaacggaccaatcatttttgcagagcagcgtgcagacaaccccgaacaaaaagagttgtaacgagtatctgtccacacccgaagccactccccttaagaacacggccaccgagaatgcgtgggctacgtcaagggtggtgagcgcatcaagcctgtcaatcgtcacgccgaccgaaatcaaaaatatactggttgacgagtttagtgaactaaaacttggtcagcccttaacagcccagcaccaacggagccatgcagttttcgagatacctgagatcgtagagaacataatcaagatgatcgtttccctcgagagcgccaatattccgaaagaacgtccgtgcctgcgtcgcaacccgcagagttatgagcattcccttctgatgtataaagacgaggaacgcgcgaagaaagcatggtccgcggctcaacaactgcgcgatccgccgctggtgggtcataaggaaaaaaaacagggcgctctgtttagctgcatgatggtcaaccgcctgtggttgaatgtcacgcgtccgttcttatttaagtctctgcatttcaaatcagtgcacaacttcaaagaatttctgcgcacaagtcaggaaaccacgcaagtgatgaggccatcgcactttatcctgcataaattgcaccaggtaacgcagccggatattgagagactgtctagaatggaatgccagaacctcaagtggttggaattttatgtatgtccccgtattacacctccactgtcttggttcgacaatttgcataagttagaaaaattaatcatccccggaaacaagaatatcgacgataatttcctcttacggctgtctcagagtattcctaacctgaaacacctcgtgcttcgtgcttgcgacaatgtttccgatagtggtgtagtttgtatcgccctgaactgccctaagctgaagacgttcaacatcggacgtcatcgccgcggcaatctgattacatcagttagcttggttgccctgggtaagtatacgcaagttgagaccgttggttttgcaggctgcgatgtggacgacgcaggcatatgggagttcgcgcgtttaaacgggaaaaacgtcgagcgcctgtcactcaacagttgccggcttttaaccgactatagcttgccaatcctgtttgcccttaatagtttcccgaaccttgcggtgttggaaattcgaaacctcgataaaattacagatgtccgccattttgtgaaatataatctgtggaagaaatcactggatgctcctatcctgattgaggcgtgcgaacgcataacaaagctgattgatcaggaagagaaccgggtcaaacgcataaatagcctggtcgctttaaaggatatgaccgcgtgggtgaacgctgacgatgaaattgaaaacaacgtcgattga

SEQ ID NO: 667 - DNA, 6638 bp, Artificial Sequence
  pLA67
aaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccgcattgcggattacgtattctaatgttcagtaccgttcgtataatgtatgctatacgaagttatgcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcgacttaggatgtctcatcaatcatcttattcctgctggtgttttttgtatcgccttgccttggagtgtttatgcttgtcctttgttcagtaaccattcttcaagtttgtttcaagtagtaggataccttcagatatacgaaagaaagggagtatagttgtggatatatatatatatagcaacccttctttataagggtcctatagactatactcttcacactttaaagtacggaattaaggcccaagggaactaacaaaaacgttcaaaaagttttaaaactatatgtgttaactgtacaaaaataacttatttatcatatcatttttttctctgtttatttcttctagaacttatacctgtcttttccttttattctttgaatttgktttaatatccctttttgktttaatatccatccattcctttcacttagaactaataattcccttcgtttgataatttatcattttccttttctgttagtaaagtacccattaaatgaagctggagcgcgtgagttctaacgggagctttaagcgtggccgtgacatccaaagtttggagagtccgtgtacccgcccattaaagaaaatgtcgccatcaccttcatttacgagcctgaagatggaaaaaccgtttaaggacattgttcgaaaatacgggggtcacctgcaccagtcctcgtataacccaggttcttcaaaagttgaactcgtgcgtccggacctgagcttgaaaacggaccaatcatttttgcagagcagcgtgcagacaaccccgaacaaaaagagttgtaacgagtatctgtccacacccgaagccactccccttaagaacacggccaccgagaatgcgtgggctacgtcaagggtggtgagcgcatcaagcctgtcaatcgtcacgccgaccgaaatcaaaaatatactggttgacgagtttagtgaactaaaacttggtcagcccttaacagcccagcaccaacggagccatgcagttttcgagatacctgagatcgtagagaacataatcaagatgatcgtttccctcgagagcgccaatattccgaaagaacgtccgtgcctgcgtcgcaacccgcagagttatgagcattcccttctgatgtataaagacgaggaacgcgcgaagaaagcatggtccgcggctcaacaactgcgcgatccgccgctggtgggtcataaggaaaaaaaacagggcgctctgtttagctgcatgatggtcaaccgcctgtggttgaatgtcacgcgtccgttcttatttaagtctctgcatttcaaatcagtgcacaacttcaaagaatttctgcgcacaagtcaggaaaccacgcaagtgatgaggccatcgcactttatcctgcataaattgcaccaggtaacgcagccggatattgagagactgtctagaatggaatgccagaacctcaagtggttggaattttatgtatgtccccgtattacacctccactgtcttggttcgacaatttgcataagttagaaaaattaatcatccccggaaacaagaatatcgacgataatttcctcttacggctgtctcagagtattcctaacctgaaacacctcgtgcttcgtgcttgcgacaatgtttccgatagtggtgtagtttgtatcgccctgaactgccctaagctgaagacgttcaacatcggacgtcatcgccgcggcaatctgattacatcagttagcttggttgccctgggtaagtatacgcaagttgagaccgttggttttgcaggctgcgatgtggacgacgcaggcatatgggagttcgcgcgtttaaacgggaaaaacgtcgagcgcctgtcactcaacagttgccggcttttaaccgactatagcttgccaatcctgtttgcccttaatagtttcccgaaccttgcggtgttggaaattcgaaacctcgataaaattacagatgtccgccattttgtgaaatataatctgtggaagaaatcactggatgctcctatcctgattgaggcgtgcgaacgcataacaaagctgattgatcaggaagagaaccgggtcaaacgcataaatagcctggtcgctttaaaggatatgaccgcgtgggtgaacgctgacgatgaaattgaaaacaacgtcgattgagacgatgaaattgaaaacaacgtcgattgaggtaccatggtttttgtgactttacctataaatagtacacaacagaccaccagtaattctacacacttcttaactgataatattattataattgtaactttttagcagcactaaatttaatgaatacatagatttttaactagcattttactattctgtactttttacttgaaattccagaagggccgaagaaaccagaattccttcacagaaaacgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaa

SEQ ID NO: 668 - DNA, 100 bp, Artificial Sequence
  LA712
cttaattgaaagaaagaatttccttcaacttcggtttcctggttccgctatttctcgcttgtttcttctagcattgcggattacgtattctaatgttcag

SEQ ID NO: 669 - DNA, 30 bp, Artificial Sequence
  LA746
gttttctgtgaaggaattctggtttcttcg

SEQ ID NO: 670 - DNA, 7223 bp, Artificial Sequence
  pBP3836
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 671 - DNA, 7398 bp, Artificial Sequence
  pBP3840
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgacagcgcaaaggattatgacactgttgcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgcgcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 672 - DNA, 7271 bp, Artificial Sequence
  pBP3933
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgactgtttgtttgaagagactaatcaaagaatcgttttctcaaaaaatttaatatcttaactgatagtttgatcaaaggggcaaaacgtaggggcaaacaaacggaaaaatcgtttctcaaattttctgatgccaagaactctaaccagtcttatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaggcagaggagagcataaaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacacaacactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 673 - DNA, 7560 bp, Artificial Sequence
  pBP3935
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgactcaatgcttctttcttgcgttctttttgttgcgcccatatattattttatttattacattcatatagcaatatttaccttattttattggttacttttctatacgcaaaatcactacactatgttatgttaaggtctccgatacgggaatataccaatcaatacttatcacttcggattttttatgggtcttatccccactgttccattttcttgtttaaggcatcccggaggataaactaaaaaggtggcccatcccacccgaaatgaaagtaatcatctgctagcaaaaagtaaagaaatgagagcatgctgtgatgtactggtggacgaaattgtgacccatacccaccgaagaaacatccgcatgacgtgttactgttacttcccggattaagggatgcattctaactctgtgcgcccttttctctgcagttgatccgcattccccgtggctgtgcacattaggggacagtaagtaattcgctttctgattccgcactcatagcgatggaataatataccggatttcacaccttgctattgagtgaagtactgcttggtgaaatgatatctttatgttcaatattaatggtcgtgtggatgaatatatgggcatgggttaattagttttaggggcacggagtaaacaagaaaggagggccagaatcattagtacagtacctcaagtttgatttctttttgatttcacgtataaaagagtctctctcttttcctttcatgctagtcgaacggttctccctctcagaataagaaactatcgaaaagaaagacaaaagtcgattgaataatttatctatatataatatacgcaaacaagattcgctttcactttgcaattttacttcatagctttgttaaaaccagcaaaaaatattatttttctagaaaaaagaatatattagaggtaaagaaagaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 674 - DNA, 7622 bp, Artificial Sequence
  pBP3937
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacaatagtactctcatcgctaagatcatttggggttgttaagcatgccctgctaaacacgccctactaaacacttcaaaagcaacttaaaatatttttatctaattatagctaaaacccaatgtgaaagacatatcatactgtaaaagtgaaaaagcagcaccgttgaacgccgcaagagtgctcccataacgctttactagagggctagattttaatggccccttcatggagaagttatgaggacaaatcccactacagaaagcgcaacaaatttttttttccgtaacaacaaacatctcatctagtttctgccttaaacaaagccgcagccagagccgtttttccgccatatttatccaggattgttccatacggctccgtcagaggctgctacgggatgttttttttttaccccgtggaaatgaggggtatgcaggaatttgtgcggggtaggaaatcttttttttttttaggaggaacaactggtggaagaatgcccacacttctcagaaatgcatgcagtggcagcacgctaattcgaaaaaattctccagaaaggcaacgcaaaattttttttccagggaataaactttttatgacccactacttctcgtaggaacaatttcgggcccctgcgtgttcttctgaggttcatcttttacatttgcttctgctggataattttcagaggcaacaaggaaaaattagatggcaaaaagtcgtctttcaaggaaaaatccccaccatctttcgagatcccctgtaacttattggcaactgaaagaatgaaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 675 - DNA, 7572 bp, Artificial Sequence
  pBP3940
tcgcgcgtttcggtgatgacggtgaaaacctctgacacatgcagctcccggagacggtcacagcttgtctgtaagcggatgccgggagcagacaagcccgtcagggcgcgtcagcgcgtgttggcgggtgtcggggctggcttaactatgcggcatcagagcagattgtactgagagtgcaccataaattcccgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttcccctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgacggatctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacaagcaagacagaaactaacttcttcttcatgtaataaacacaccccgcgtttatttacctatctttaaacttcaacaccttatatcataactaatatttcttgagataagcacactgcacccataccttccttaaaaacgtagcttccagtttttggtggttctggcttccttcccgattccgcccgctaaacgcataattttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccgtttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttggaatcagatttgggtttgttccctttattttcatatttcttgtcatattcttttctcaattattatcttctactcataacctcacgcaaaataacacagtcaaatcaatcaaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtccttttcatcacgtgctataaaaataattataatttaaattttttaatataaatatataaattaaaaatagaaagtaaaaaaagaaattaaagaaaaaatagtttttgttttccgaagatgtaaaagactctagggggatcgccaacaaatactaccttttatcttgctcttcctgctctcaggtattaatgccgaattgtttcatcttgtctgtgtagaagaccacacacgaaaatcctgtgattttacattttacttatcgttaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaagatacgaggcgcgtgtaagttacaggcaagcgatccgtcctaagaaaccattattatcatgacattaacctataaaaataggcgtatcacgaggccctttcgtc

SEQ ID NO: 676 - DNA, 12319 bp, Artificial Sequence
  pLH689::I2V5
tcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagattaatcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcgggcggccgcacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttaaacagtatggaagaatgtaagatggctaagatttactaccaagaagactgtaacttgtccttgttggatggtaagactatcgccgttatcggttacggttctcaaggtcacgctcatgccctgaatgctaaggaatccggttgtaacgttatcattggtttatacgaaggtgcggaggagtggaaaagagctgaagaacaaggtttcgaagtctacaccgctgctgaagctgctaagaaggctgacatcattatgatcttgatcccagatgaaaagcaggctaccatgtacaaaaacgacatcgaaccaaacttggaagccggtaacatgttgatgttcgctcacggtttcaacatccatttcggttgtattgttccaccaaaggacgttgatgtcactatgatcgctccaaagggtccaggtcacaccgttagatccgaatacgaagaaggtaaaggtgtcccatgcttggttgctgtcgaacaagacgctactggcaaggctttggatatggctttggcctacgctttagccatcggtggtgctagagccggtgtcttggaaactaccttcagaaccgaaactgaaaccgacttgttcggtgaacaagctgttttatgtggtggtgtctgcgctttgatgcaggccggttttgaaaccttggttgaagccggttacgacccaagaaacgcttacttcgaatgtatccacgaaatgaagttgatcgttgacttgatctaccaatctggtttctccggtatgcgttactctatctccaacactgctgaatacggtgactacattaccggtccaaagatcattactgaagataccaagaaggctatgaagaagattttgtctgacattcaagatggtacctttgccaaggacttcttggttgacatgtctgatgctggttcccaggtccacttcaaggctatgagaaagttggcctccgaacacccagctgaagttgtcggtgaagaaattagatccttgtactcctggtccgacgaagacaagttgattaacaactgaggccctgcaggccagaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtggacggcccctttccaacgaatcgtatatactaacatgcgcgcgcttcctatatacacatatacatatatatatatatatatatgtgtgcgtgtatgtgtacacctgtatttaatttccttactcgcgggtttttcttttttctcaattcttggcttcctctttctcgagcggaccggatcctcgcgaactccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacgcggccgcttaaccacagcaaccaggacaacattttttgccagtttcttcaggcttccaaaagtctgttacggctcccctagaagcagacgaaacgatgtgagcatatttaccaaggataccgcgtgaatagagcggtggcaattcaatggtctcttgacgatgttttaactcttcatcggagatatcaaagtgtaattccttagtgtcttggtcaatagtgactatgtctcctgtttgcaggtaggcgattggaccgccatcttgtgcttcaggagcgatatgacccacgacaagaccataagtaccacctgagaagcggccatctgtcagaagggcaactttttcaccttgccctttaccaacaatcattgatgaaagggaaagcatttcaggcataccaggaccgccctttggtcctacaaaacgtacgacaacaacatcaccatcaacaatatcatcattcaagacagcttcaatggcttcttcttcagaattaaagaccttagcaggaccgacatgacgacgcacttttacaccagaaactttggcaacggcaccgtctggagccaagttaccatggagaacaatgagcggaccatcttcacgtttaggattttcaagcggcataataaccttttgaccaggtgttaaatcatcaaaagccttcaaattttcagcgactgttttgccagtacaagtgatacggtcaccatgaaggaagccatttttaaggagatatttcataactgctggtacccctccgaccttgtaaaggtcttggaatacatattgaccagaaggtttcaaatcagccaaatgaggaactttttcttggaaagtattgaaatcatcaagtgtcaattccacattagcagcatgggcaatagctaagaggtgaagggttgagttggttgaacctcccagagccatagttacagtaatagcatcttcaaaagcttcacgcgttaaaatgtcagaaggttttaagcccatttcgagcattttgacaacagcgcgaccagcttcttcaatatctgctttcttttctgcggattcagccgggtgagaagatgaacccggaaggctaagtcccaaaacttcaatagctgtcgccattgtgttagcagtatacataccaccgcagcctccaggaccgggacaagcattacattccaaagctttaacttcttctttggtcatatcgccgtggttccaatggccgacaccttcaaagacagagactaaatcgatatctttgccgtctaaattaccaggtgcaattgttccgccgtaagcaaaaatggctgggatatccatgttagccatagcgataacagaaccgggcatgtttttatcacaaccgccaatggctacaaaagcatccgcattatgacctcccatggctgcttcaatagaatctgcaataatatcacgagatgtcaaggagaaacgcattccttgggttcccatggcgattccatcagaaaccgtgattgttccgaactgaactggccaagcaccagcttccttaacaccgactttggctagtttaccaaagtcatgtaagtggatattacaaggtgtgttttcagcccaagttgaaatgacaccgacgataggtttttcaaagtcttcatcttgcataccagttgcacgcaacatagcacgattaggtgatttaaccattgaatcgtaaacagaactacgatttcttaagtctttaagagtttttttgtcagtcatactcacgtgaaacttagattagattgctatgctttctttccaatgagcaagaagtaaaaaaagttgtaatagaacaggaaaaatgaagctgaaacttgagaaattgaagaccgtttgttaactcaaatatcaatgggaggtcgtcgaaagagaacaaaatcgaaaaaaaagttttcaagagaaagaaacgtgataaaaatttttattgccttctccgacgaagaaaaagggacgaggcggtctctttttccttttccaaacctttagtacgggtaattaacggcaccctagaggaaggaggagggggaatttagtatgctgtgcttgggtgttttgaagtggtacggcggtgcgcggagtccgagaaaatctggaagagtaaaaaaggagtagagacattttgaagctatgccggcagatctatttaaatggcgcgccgacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttgcatgcctgcaggtcgactctagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcattttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagccttcttggaggcttccagcgcctcatctggaagtggaacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacattacaatggtatatccttgaaatatatataaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagaggatc

SEQ ID NO: 677 - DNA, 32 bp, Artificial Sequence
  N1387
catgagcttagccctccgtagacgctcctctg

SEQ ID NO: 678 - DNA, 32 bp, Artificial Sequence
  N1388
gcaacgctaagccttggcattttcaaaggcac

SEQ ID NO: 679 - skipped

SEQ ID NO: 680 - DNA, 21 bp, Artificial Sequence
  N1389
ctgcgcgttcctttgataggc

SEQ ID NO: 681 - DNA, 22 bp, Artificial Sequence
  N1411
ctgagatacctacagcgtgagc

SEQ ID NO: 682 - DNA, 27 bp, Artificial Sequence
  GUS729R
acagttcatagagataaccttcacccg

SEQ ID NO: 683 - DNA, 21 bp, Artificial Sequence
  N1310
tcgaggtcgacgcctacttgg

SEQ ID NO: 684 - DNA, 21 bp, Artificial Sequence
  N1311
ctacaggacgtaccatactag

SEQ ID NO: 685 - skipped

SEQ ID NO: 686 - DNA, 709 bp, Artificial Sequence
  P[FBA1::DAN1_AR314)
gcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagccctccgtagacgctcctctgaaaagtttcatgtttcctgcgcgttcctttgataggcaataaaacaatacaacgcgtgcctttgaaaatgccaaggcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagt

SEQ ID NO: 687 - DNA, 40 bp, Artificial Sequence
  N1443
gactgcggccgcctacttggcttcacatacgttgcatacg

SEQ ID NO: 688 - DNA, 38 bp, Artificial Sequence
  N1444
cgaccttaattaattgaatatgtattacttggttatgg

SEQ ID NO: 689 - skipped

SEQ ID NO: 690 - DNA, 21 bp, Artificial Sequence
  N1452
gataataatgataatgacagc

SEQ ID NO: 691 - DNA, 21 bp, Artificial Sequence
  N1457
caatcgggtcatagccgatcg

SEQ ID NO: 692 - DNA, 20 bp, Artificial Sequence
  N1445
gagtccactattaaagaacg

SEQ ID NO: 693 - DNA, 23 bp, Artificial Sequence
  N1446
caggtcctttatcttgtaaagcg

SEQ ID NO: 694 - DNA, 20 bp, Artificial Sequence
  N1447
cttggcttcacatacgttgc

SEQ ID NO: 695 - DNA, 23 bp, Artificial Sequence
  N1448
gaatatgtattacttggttatgg

SEQ ID NO: 696 - DNA, 20 bp, Artificial Sequence
  N1459
gtgacttcattcacaacatc

SEQ ID NO: 697 - DNA, 7213 bp, Artificial Sequence
  pJT336
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagccctccgtagacgctcctctgaaaagtttcatgtttcctgcgcgttcctttgataggcaataaaacaatacaacgcgtgcctttgaaaatgccaaggcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaattaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 698 - DNA, 31 bp, Artificial Sequence
  N1463
gtgagcagtgtctccgacgatttggatatcg

SEQ ID NO: 699 - DNA, 28 bp, Artificial Sequence
  N1464
gagtagcagcacgttccttatatgtagc

SEQ ID NO: 700 - DNA, 27 bp, Artificial Sequence
  N1465
gtgacaagcttccgaaagaattcgggg

SEQ ID NO: 701 - DNA, 30 bp, Artificial Sequence
  N1466
cactgtttaaacagtgttccttaatcaagg

SEQ ID NO: 702 - DNA, 29 bp, Artificial Sequence
  N1467
cagttgttagatatggaaagagaggatgc

SEQ ID NO: 703 - DNA, 30 bp, Artificial Sequence
  N1316
ctactagtgccaccatggctcagtcaaagc

SEQ ID NO: 704 - DNA, 25 bp, Artificial Sequence
  N1317
gagtcgcggccgctcagggcaatgc

SEQ ID NO: 705 - DNA, 7140 bp, Artificial Sequence
  pJT257
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgaggtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 706 - DNA, 40 bp, Artificial Sequence
  N1424
gagtgcttagcgacagcgcaaaggattatgacactgttgc

SEQ ID NO: 707 - DNA, 40 bp, Artificial Sequence
  N1425
gcaggctaagcgcacggcaatgccctgcagcatttcttcc

SEQ ID NO: 708 - DNA, 21 bp, Artificial Sequence
  N1314
gcagctggcacgacaggtttc

SEQ ID NO: 709 - DNA, 21 bp, Artificial Sequence
  N1323
gtcccatgtataaccagcagg

SEQ ID NO: 710 - DNA, 7315 bp, Artificial Sequence
  pJT331
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctgggtaccgggccccccctcgaggtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgacagcgcaaaggattatgacactgttgcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgcgcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaactagtgccaccatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgccctgagcggccgcgttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctcttccaaccaagcctcattgctccttgatttactggtgaaaagtgatacactttgcgcgcaatccaggtcaaaactttcctgcaaagaattcaccaatttctcgacatcatagtacaatttgttttgttctcccatcacaatttaatatacctgatggattcttatgaagcgctgggtaatggacgtgtcactctacttcgcctttttccctactccttttagtacggaagacaatgctaataaataagagggtaataataatattattaatcggcaaaaaagattaaacgccaagcgtttaattatcagaaagcaaacgtcgtaccaatccttgaatgcttcccaattgtatattaagagtcatcacagcaacatattcttgttattaaattaattattattgatttttgatattgtataaaaaaaccaaatatgtataaaaaaagtgaataaaaaataccaagtatggagaaatatattagaagtctatacgttaaaccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 711 - DNA, 776 bp, Artificial Sequence
  P[FBA1::HXT1_331]
gcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgacagcgcaaaggattatgacactgttgcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgcgcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 712 - DNA, 31 bp, Artificial Sequence
  N1453
gactgcggccgcctacttggcttcacatacg

SEQ ID NO: 713 - DNA, 37 bp, Artificial Sequence
  N1454
cacgttaattaattgaatatgtattacttggttatgg

SEQ ID NO: 714 - skipped

SEQ ID NO: 715 - DNA, 19 bp, Artificial Sequence
  N1434
ccgaagtgacccagtgctc

SEQ ID NO: 716 - DNA, 7286 bp, Artificial Sequence
  pJT337
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatccggcgcgccgtttaaacaaaatgaaggccaaatcaaggcgggaagggacaaccaggacgtaaagggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacggccggccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtggcggccgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgacagcgcaaaggattatgacactgttgcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgcgcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaattaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaaggagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 717 - DNA, 28 bp, Artificial Sequence
  N1468
caactattacgtattacgataatcctgc

SEQ ID NO: 718 - DNA, 17 bp, Artificial Sequence
  alsS-559F
gctgttgcagcgccaaa

SEQ ID NO: 719 - DNA, 19 bp, Artificial Sequence
  alsS-618R
tgctatggccgcactgatt

SEQ ID NO: 720 - DNA, 22 bp, Artificial Sequence
  alsS-577T
ctcggtcctgcagcagatgatg

SEQ ID NO: 721 - DNA, 21 bp, Artificial Sequence
  18S-396F
agaaacggctaccacatccaa

SEQ ID NO: 722 - DNA, 25 bp, Artificial Sequence
  18S-468R
tcactacctccctgaattaggattg

SEQ ID NO: 723 - DNA, 21 bp, Artificial Sequence
  18S-420T
aaggcagcaggcgcgcaaatt

SEQ ID NO: 724 - DNA, 21 bp, Artificial Sequence
  HXT1-1586F
ccgaaggtgttctaccatgga

SEQ ID NO: 725 - DNA, 22 bp, Artificial Sequence
  HXT1-1647R
gtcagcgcctctcttggatact

SEQ ID NO: 726 - DNA, 15 bp, Artificial Sequence
  HXT1-1610T
cagcttcctgggttc

SEQ ID NO: 727 - DNA, 24 bp, Artificial Sequence
  HXT3-744F
tggtatgactttcgttccagaatc

SEQ ID NO: 728 - DNA, 22 bp, Artificial Sequence
  HXT3-814R
atgctcttgcttcgtcaatttg

SEQ ID NO: 729 - DNA, 23 bp, Artificial Sequence
  HXT3-769T
ccacgttatttggttgaagctgg

SEQ ID NO: 730 - DNA, 25 bp, Artificial Sequence
  tef1-739F
ccattgcaagatgtttacaagattg

SEQ ID NO: 731 - DNA, 22 bp, Artificial Sequence
  tef1-811R
tgatgacaccggtttcaactct

SEQ ID NO: 732 - DNA, 23 bp, Artificial Sequence
  tef1-765T
tggtattggtactgtgccagtcg

SEQ ID NO: 733 - DNA, 71 bp, Artificial sequence
  AK11-52
ccagacaagaagttgccgacagtctgttgaattggcctggttaggcttaaaactcgttgtatcatcactgg

SEQ ID NO: 734 - DNA, 80 bp, Artificial sequence
  AK11-55
cctctgtttttcacaagggatttttgttcttttgttgcttttgtcaacattatttcgatagtaaatattacgttgaaaag

SEQ ID NO: 735 - DNA, 21 bp, Artificial sequence
  AK11-56
tgctcacatcgtttcgtctgc

SEQ ID NO: 736 - DNA, 21 bp, Artificial sequence
  AK11-57
gctatgattgacccagtgttc

SEQ ID NO: 737 - DNA, 21 bp, Artificial sequence
  AK11-58
cccacgctataaattggctac

SEQ ID NO: 738 - DNA, 21 bp, Artificial sequence
  AK11-59
tcctgatgtgactaacacgac

SEQ ID NO: 739 - DNA, 30 bp, Artificial sequence
  AK11-60
cttggatccaactcgttgtatcatcactgg

SEQ ID NO: 740 - DNA, 31 bp, Artificial sequence
  AK11-61
tcatctagagattacgtattctaatgttcag

SEQ ID NO: 741 - DNA, 31 bp, Artificial sequence
  AK11-62
tcatctagaggaacggggctgtatgtttatg

SEQ ID NO: 742 - DNA, 39 bp, Artificial sequence
  AK11-63
cttgtcgactatttcgatagtaaatattacgttgaaaag

SEQ ID NO: 743 - DNA, 40 bp, Artificial sequence
  Primer oBP691
aattggatccgcgatcgcgacgttctctccgttgttcaaa

SEQ ID NO: 744 - DNA, 34 bp, Artificial sequence
  Primer oBP696
aattttaattaaacgggcatcttatagtgtcgtt

SEQ ID NO: 745 - DNA, 32 bp, Artificial sequence
  Primer oBP622
aattggtaccccaaaaggaatattgggtcaga

SEQ ID NO: 746 - DNA, 49 bp, Artificial sequence
  Primer oBP623
ccattgtttaaacggcgcgccggatcctttgcgaaaccctatgctctgt

SEQ ID NO: 747 - DNA, 49 bp, Artificial sequence
  Primer oBP624
gcaaaggatccggcgcgccgtttaaacaatggaaggtcgggatgagcat

SEQ ID NO: 748 - DNA, 34 bp, Artificial sequence
  Primer oBP625
aattggccggcctacgtaacattctgtcaaccaa

SEQ ID NO: 749 - DNA, 34 bp, Artificial sequence
  oBP626
aattgcggccgcttcatatatgacgtaataaaat

SEQ ID NO: 750 - DNA, 34 bp, Artificial sequence
  oBP627
aattttaattaattttttttcttggaatcagtac

SEQ ID NO: 751 - DNA, 40 bp, Artificial sequence
  Primer HY21
ttaaggcgcgcctatttgtaatacgtatacgaattccttc

SEQ ID NO: 752 - DNA, 56 bp, Artificial sequence
  Primer HY24
acttaataactttaccggctgttgacattttgttcttcttgttattgtattgtgtt

SEQ ID NO: 753 - DNA, 56 bp, Artificial sequence
  Primer HY25
aacacaatacaataacaagaagaacaaaatgtcaacagccggtaaagttattaagt

SEQ ID NO: 754 - DNA, 40 bp, Artificial sequence
  Primer HY4
ggaagtttaaacaccacaggtgttgtcctctgaggacata

SEQ ID NO: 755 - DNA, 30 bp, Artificial sequence
  Primer URA3-end F
gcatatttgagaagatgcggccagcaaaac

SEQ ID NO: 756 - DNA, 22 bp, Artificial sequence
  Primer oBP637
tttttgcacagttaaactaccc

SEQ ID NO: 757 - DNA, 22 bp, Artificial sequence
  Primer oBP636
catttttttccctctaagaagc

SEQ ID NO: 758 - DNA, 34 bp, Artificial sequence
  Primer oBP695
aattgcggccgcatgacaggtgaaagaattgaaa

SEQ ID NO: 759 - DNA, 34 bp, Artificial sequence
  Primer HY31
gccgactttatggcgaagaagtttgctcttgatc

SEQ ID NO: 760 - DNA, 34 bp, Artificial sequence
  Primer oBP693
aattgtttaaacaaaggatgatattgttctatta

SEQ ID NO: 761 - DNA, 33 bp, Artificial sequence
  Primer oBP694
aattggccggccgcaacgacgacaatgccaaac

SEQ ID NO: 762 - DNA, 56 bp, Artificial sequence
  Primer HY20
gcaaaataacacagtcaaatcaatcaaaatgtcaacagccggtaaagttattaagt

SEQ ID NO: 763 - DNA, 41 bp, Artificial sequence
  Primer oBP692
aattggcgcgccatttaaatatatatgtatatatataacac

SEQ ID NO: 764 - DNA, 22 bp, Artificial sequence
  Primer oBP730
ttgctccaaagagatgtcttta

SEQ ID NO: 765 - DNA, 22 bp, Artificial sequence
  Primer oBP731
tgttcccacaatctattaccta

SEQ ID NO: 766 - DNA, 40 bp, Artificial sequence
  Primer HY16
ttaaggcgcgccccgcacgccgaaatgcatgcaagtaacc

SEQ ID NO: 767 - DNA, 56 bp, Artificial sequence
  Primer HY19
acttaataactttaccggctgttgacattttgattgatttgactgtgttattttgc

SEQ ID NO: 768 - DNA, 1350 bp, Saccharomyces cerevisiae; identical to SEQ ID NO: 169

SEQ ID NO: 769 - DNA, 2045 bp, Saccharomyces cerevisiae; identical to SEQ ID NO: 168

SEQ ID NO: 770 - DNA, 601 bp, Saccharomyces cerevisiae
gcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaa

SEQ ID NO: 771 - DNA, 649 bp, Saccharomyces cerevisiae
tgtttgtttgaagagactaatcaaagaatcgttttctcaaaaaatttaatatcttaactgatagtttgatcaaaggggcaaaacgtaggggcaaacaaacggaaaaatcgtttctcaaattttctgatgccaagaactctaaccagtcttatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaggcagaggagagcataaaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacacaac

SEQ ID NO: 772 - DNA, 937 bp, Saccharomyces cerevisiae
tcaatgcttctttcttgcgttctttttgttgcgcccatatattattttatttattacattcatatagcaatatttaccttattttattggttacttttctatacgcaaaatcactacactatgttatgttaaggtctccgatacgggaatataccaatcaatacttatcacttcggattttttatgggtcttatccccactgttccattttcttgtttaaggcatcccggaggataaactaaaaaggtggcccatcccacccgaaatgaaagtaatcatctgctagcaaaaagtaaagaaatgagagcatgctgtgatgtactggtggacgaaattgtgacccatacccaccgaagaaacatccgcatgacgtgttactgttacttcccggattaagggatgcattctaactctgtgcgcccttttctctgcagttgatccgcattccccgtggctgtgcacattaggggacagtaagtaattcgctttctgattccgcactcatagcgatggaataatataccggatttcacaccttgctattgagtgaagtactgcttggtgaaatgatatctttatgttcaatattaatggtcgtgtggatgaatatatgggcatgggttaattagttttaggggcacggagtaaacaagaaaggagggccagaatcattagtacagtacctcaagtttgatttctttttgatttcacgtataaaagagtctctctcttttcctttcatgctagtcgaacggttctccctctcagaataagaaactatcgaaaagaaagacaaaagtcgattgaataatttatctatatataatatacgcaaacaagattcgctttcactttgcaattttacttcatagctttgttaaaaccagcaaaaaatattatttttctagaaaaaagaatatattagaggtaaagaaag

SEQ ID NO: 773 - DNA, 1000 bp, Saccharomyces cerevisiae; identical to SEQ ID NO: 331

SEQ ID NO: 774 - DNA, 950 bp, Saccharomyces cerevisiae
agcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacaagcaagacagaaactaacttcttcttcatgtaataaacacaccccgcgtttatttacctatctttaaacttcaacaccttatatcataactaatatttcttgagataagcacactgcacccataccttccttaaaaacgtagcttccagtttttggtggttctggcttccttcccgattccgcccgctaaacgcataattttgttgcctggtggcatttgcaaaatgcataacctatgcatttaaaagattatgtatgctcttctgacttttcgtgtgatgaggctcgtggaaaaaatgaataatttatgaatttgagaacaattttgtgttgttacggtattttactatggaataatcaatcaattgaggattttatgcaaatatcgtttgaatatttttccgaccctttgagtacttttcttcataattgcataatattgtccgctgcccgtttttctgttagacggtgtcttgatctacttgctatcgttcaacaccaccttattttctaactattttttttttagctcatttgaatcagcttatggtgatggcacatttttgcataaacctagctgtcctcgttgaacataggaaaaaaaaatatataaacaaggctctttcactctccttggaatcagatttgggtttgttccctttattttcatatttcttgtcatattcttttctcaattattatcttctactcataacctcacgcaaaataacacagtcaaatcaatcaaa

SEQ ID NO: 775 - DNA, 902 bp, Saccharomyces cerevisiae
tttatgctgcaaaggtcctaatgtataaggaaagaatatttagagaaaagaagaaaacaagagttttatatacatacagagcacatgcatgccatatgatcatgtgttgtcgcacacatatatatatgcctgtatgtgtcagcactaaagttgcctggccatccacgctatatatacacgcctggcggatctgctcgaggattgcctacgcgtgggcttgatccaccaaccaacgctcgccaaatgaactggcgctttggtcttctgccatcgtccgtaaaccccggccaaagagaccggaaagatcggtgaaaacatcttgatcttgctcccgggaattttagattcaggtaggaaattgattacatcaatactgttaccctgaatcatattcgacgatgtcgtctcacacggaaatataattcatttcttggttttccaaaaaaattttcattttttttcacttttttgtttcgtcctcctttttttttttttttttttattttttttcctgtgttcacttttttttttttcagtttacatctttctgcattcttttctgtgtttttttttttttttttcgtttttccattgttcgttcgttgcctgttttttcgccctattgttctcgagcctaaaaattttttcctttcctgctttcctttcttcgttcaaagtttcctattccattgttctctttggtaaactcattgttgtcggaactcagatatattcaggtcaatttactgtacttcaattgacttttttcttgaaatttcaacttgccttttcaacttgttcttcttttttaatcttattctacactttagttcccttaccttgttcctaattattgtctagcaaaaagaaaacatacacctatttcattcacacactaaaac

SEQ ID NO: 776 - DNA, 1200 bp, Saccharomyces cerevisiae; identical to SEQ ID NO: 175

SEQ ID NO: 777 - DNA, 1098 bp, Saccharomyces cerevisiae
ccgtatctaacgtaataaacgatatctattttcgaggcgctcgacatctcgtatctgggacagaaagtgaggtagattattcaagaatacctattaagaaaggtagaaggtattgcaccgattcctagtatcaattcttttcaaaaccacttattttgcaaaacatgcgtctaacctgccatttcagcaacgtaaataataattacttccatatatattcttctcccccagtagcaattttgacatgacaaatttcagcgatagttgcttcggcattcgaaaatcgtagaagtatgtcttaatgtagaaggttgagaacaaccggatcttgcggtcatttttcttttcgaggaaagtgcaagtctgccactttccagaaggcatagccttgcccttttgttgatatttctccccaccgtaattgttgcattcgcgatcttttcaacaatacattttatcatcaagcccgcaaatcctctggagtttgtcctctcgttcactgttgggaaaaacaatacgcctaattcgtgattaagattcttcaaaccatttcctgcggagtttttactgtgtgttgaacggttcacagcgtaaaaaaaagttactataggcacggtattttaatttcaattgtttagaaagtgccttcacaccattagcccctgggattaccgtcataggcactttctgctgagctcctgcgagatttttgcgctgaaagagtaaaagaaatctttcacagcggctccgcgggcccttctacttttaaacgagtcgcaggaacagaagccaaatttcaaagaacgctacgctttcgccgtttctggttctcccaccaataacgctccagcttgaacaaagcataagactgcaaccaaagcgctgacggacgatccgaagataaagcttgctttgcccattgttctcgtttcgaaaggctatataaggacacggattttcctttttttttccacctattgtctttctttgttaagcttttattctccgggttttttttttgagcatatcgaaagctttcttttcgcaaatcaaacatagcaaaccgaactcttcgaacacaattaaatacacataaag

SEQ ID NO: 778 - DNA, 452 bp, Saccharomyces cerevisiae; identical to SEQ ID NO: 177

SEQ ID NO: 779 - DNA, 1000 bp, Saccharomyces cerevisiae
actggtagagagcgactttgtatgccccaattgcgaaacccgcgatatccttctcgattctttagtacccgaccaggacaaggaaaaggaggtcgaaacgtttttgaagaaacaagaggaactacacggaagctctaaagatggcaaccagccagaaactaagaaaatgaagttgatggatccaactggcaccgctggcttgaacaacaataccagccttccaacttctgtaaataacggcggtacgccagtgccaccagtaccgttacctttcggtatacctcctttccccatgtttccaatgcccttcatgcctccaacggctactatcacaaatcctcatcaagctgacgcaagccctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 780 - DNA, 30 bp, Artificial sequence
  otTA1
aacgcggccgccagctgaagcttcgtacgc

SEQ ID NO: 781 - DNA, 31 bp, Artificial sequence
  otTA2
tccgcggccgcataggccactagtggatctg

SEQ ID NO: 782 - DNA, 30 bp, Artificial sequence
  oTetO1
gacggatccccgggttaattaaggcgcgcc

SEQ ID NO: 783 - DNA, 32 bp, Artificial sequence
  oTetO2
aacggatcccccgaattgatccggtaatttag

SEQ ID NO: 784 - DNA, 69 bp, Artificial sequence
  otTA3
ttccggtttccttgaaatttttttgattcggtaatctccgagcagaaggacagctgaagcttcgtacgc

SEQ ID NO: 785 - DNA, 70 bp, Artificial sequence
  otTA4
caaattagagcttcaatttaattatatcagttattacccgggaatctcggataggccactagtggatctg

SEQ ID NO: 786 - DNA, 71 bp, Artificial sequence
  oTetO3
ccagacaagaagttgccgacagtctgttgaattggcctggttaggcttaaccgggttaattaaggcgcgcc

SEQ ID NO: 787 - DNA, 77 bp, Artificial sequence
  oTetO4
cctctgtttttcacaagggatttttgttcttttgttgcttttgtcaacattattcccgaattgatccggtaatttag

SEQ ID NO: 788 - DNA, 21 bp, Artificial sequence
  oTetO5
ggcatgcatgtgctctgtatg

SEQ ID NO: 789 - protein, 570 aa, Bacillus subtilis
MTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 790 - DNA, 2767 bp, Artificial sequence
  Expression construct
gcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgacagcgcaaaggattatgacactgttgcattgagtcaaaagtttttccgaagtgacccagtgctctttttttttttccgtgaaggactgacaaatatgcgcacaagatccaatacgtaatggaaattcggaaaaactaggaagaaatgctgcagggcattgccgtgcgcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaattaattaaatgttgacaaaagcaacaaaagaacaaaaatcccttgtgaaaaacagaggggcggagcttgttgttgattgcttagtggagcaaggtgtcacacatgtatttggcattccaggtgcaaaaattgatgcggtatttgacgctttacaagataaaggacctgaaattatcgttgcccggcacgaacaaaacgcagcattcatggcccaagcagtcggccgtttaactggaaaaccgggagtcgtgttagtcacatcaggaccgggtgcctctaacttggcaacaggcctgctgacagcgaacactgaaggagaccctgtcgttgcgcttgctggaaacgtgatccgtgcagatcgtttaaaacggacacatcaatctttggataatgcggcgctattccagccgattacaaaatacagtgtagaagttcaagatgtaaaaaatataccggaagctgttacaaatgcatttaggatagcgtcagcagggcaggctggggccgcttttgtgagctttccgcaagatgttgtgaatgaagtcacaaatacgaaaaacgtgcgtgctgttgcagcgccaaaactcggtcctgcagcagatgatgcaatcagtgcggccatagcaaaaatccaaacagcaaaacttcctgtcgttttggtcggcatgaaaggcggaagaccggaagcaattaaagcggttcgcaagcttttgaaaaaggttcagcttccatttgttgaaacatatcaagctgccggtaccctttctagagatttagaggatcaatattttggccgtatcggtttgttccgcaaccagcctggcgatttactgctagagcaggcagatgttgttctgacgatcggctatgacccgattgaatatgatccgaaattctggaatatcaatggagaccggacaattatccatttagacgagattatcgctgacattgatcatgcttaccagcctgatcttgaattgatcggtgacattccgtccacgatcaatcatatcgaacacgatgctgtgaaagtggaatttgcagagcgtgagcagaaaatcctttctgatttaaaacaatatatgcatgaaggtgagcaggtgcctgcagattggaaatcagacagagcgcaccctcttgaaatcgttaaagagttgcgtaatgcagtcgatgatcatgttacagtaacttgcgatatcggttcgcacgccatttggatgtcacgttatttccgcagctacgagccgttaacattaatgatcagtaacggtatgcaaacactcggcgttgcgcttccttgggcaatcggcgcttcattggtgaaaccgggagaaaaagtggtttctgtctctggtgacggcggtttcttattctcagcaatggaattagagacagcagttcgactaaaagcaccaattgtacacattgtatggaacgacagcacatatgacatggttgcattccagcaattgaaaaaatataaccgtacatctgcggtcgatttcggaaatatcgatatcgtgaaatatgcggaaagcttcggagcaactggcttgcgcgtagaatcaccagaccagctggcagatgttctgcgtcaaggcatgaacgctgaaggtcctgtcatcatcgatgtcccggttgactacagtgataacattaatttagcaagtgacaagcttccgaaagaattcggggaactcatgaaaacgaaagctctctaggtcgaggcgatttaatctctaattattagttaaagttttataagcatttttatgtaacgaaaaataaattggttcatattattactgcactgtcacttaccatggaaagaccagacaagaagttgccgacagtctgttgaattggcttaagtctgggtccgcttctttctaaatttgaagaatttctcttaaacgatatgtatattcttttcgttggaaaagatgtcttccaaaaaaaaaaaaccgatgaattagtggaaccaagga

SEQ ID NO: 791 - protein, 343 aa, Artificial sequence
  Anaerostipes caccae KARI variant K9JB4P
MEECKMAKIYYQEDCNLSLLDGKTIAVIGYGSQGHAHALNAKESGCNVIIGLYEGAEEWKRAEEQGFEVYTAAEAAKKADIIMILIPDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 792 - protein, 571 aa, Artificial sequence
  S. mutans DHAD variant I2V5
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIVLHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 793 - protein, 571 aa, Streptococcus mutans
MTDKKTLKDLRNRSSVYDSMVKSPNRAMLRATGMQDEDFEKPIVGVISTWAENTPCNIHLHDFGKLAKVGVKEAGAWPVQFGTITVSDGIAMGTQGMRFSLTSRDIIADSIEAAMGGHNADAFVAIGGCDKNMPGSVIAMANMDIPAIFAYGGTIAPGNLDGKDIDLVSVFEGVGHWNHGDMTKEEVKALECNACPGPGGCGGMYTANTMATAIEVLGLSLPGSSSHPAESAEKKADIEEAGRAVVKMLEMGLKPSDILTREAFEDAITVTMALGGSTNSTLHLLAIAHAANVELTLDDFNTFQEKVPHLADLKPSGQYVFQDLYKVGGVPAVMKYLLKNGFLHGDRITCTGKTVAENLKAFDDLTPGQKVIMPLENPKREDGPLIILHGNLAPDGAVAKVSGVKVRRHVGPAKVFNSEEEAIEAVLNDDIVDGDVVVVRFVGPKGGPGMPEMLSLSSMIVGKGQGEKVALLTDGRFSGGTYGLVVGHIAPEAQDGGPIAYLQTGDIVTIDQDTKELHFDISDEELKHRQETIELPPLYSRGILGKYAHIVSSASRGAVTDFWKPEETGKK

SEQ ID NO: 794 - protein, 570 aa, Lactococcus lactis
MEFKYNGKVESIELNKYSKTLTQDPTQPATQAMHYGIGFKDEDFKKAQVGIVSMDWDGNPCNMHLGTLGSKIKNSVNQTDGLIGLQFHTIGVSDGIANGKLGMRYSLVSREVIADSIETNAGAEYYDAIVAVPGCDKNMPGSIIGMARLNRPSIMVYGGTIEHGEYKGEKLNIVSAFEALGQKITGNISEEDYHGVICNAIPGQGACGGMYTANTLASAIETLGMSLPYSASNPAVSQEKEDECDEIGLAIKNLLEKDIKPSDIMTKEAFENAITIVMVLGGSTNAVLHIIAMANAIGVEITQDDFQRISDVTPVLGDFKPSGKYMMEDLHKIGGVPAVLKYLLKEGKLHGDCLTVTGKTLAENVETALDLDFDSQDIIRPLENPIKATGHLQILYGNLAEGGSVAKISGKEGEFFKGTARVFDGEQHFIDGIESGRLHAGDVAVIRNIGPVGGPGMPEMLKPTSALIGAGLGKSCALITDGRFSGGTHGFVVGHIVPEAVEGGLIGLVEDDDIIEIDAVNNSISLKVADDEIARRRANYQKPAPKATRGVLAKFAKLTRPASEGCVTDL

SEQ ID NO: 795 - protein, 548 aa, Lactococcus lactis; identical to SEQ ID NO: 25

SEQ ID NO: 796 - protein, 548 aa, Listeria grayi
MYTVGQYLVDRLEEIGIDKVFGVPGDYNLTFLDYIQNHEGLSWQGNTNELNAAYAADGYARERGVSALVTTFGVGELSAINGTAGSFAEQVPVIHIVGSPTMNVQSNKKLVHHSLGMGNFHNFSEMAKEVTAATTMLTEENAASEIDRVLETALLEKRPVYINLPIDIAHKAIVKPAKALQTEKSSGEREAQLAEIILSHLEKAAQPIVIAGHEIARFQIRERFENWINQTKLPVTNLAYGKGSFNEENEHFIGTYYPAFSDKNVLDYVDNSDFVLHFGGKIIDNSTSSFSQGFKTENTLTAANDIIMLPDGSTYSGISLNGLLAELEKLNFTFADTAAKQAELAVFEPQAETPLKQDRFHQAVMNFLQADDVLVTEQGTSSFGLMLAPLKKGMNLISQTLWGSIGYTLPAMIGSQIAAPERRHILSIGDGSFQLTAQEMSTIFREKLTPVIFIINNDGYTVERAIHGEDESYNDIPTWNLQLVAETFGGDAETVDTHNVFTETDFANTLAAIDATPQKAHVVEVHMEQMDMPESLRQIGLALSKQNS

SEQ ID NO: 797 - protein, 546 aa, Macrococcus caseolyticus
MKQRIGQYLIDALHVNGVDKIFGVPGDFTLAFLDDIIRHDNVEWVGNTNELNAAYAADGYARVNGLAAVSTTFGVGELSAVNGIAGSYAERVPVIKISGGPSSVAQQEGRYVHHSLGEGIFDSYSKMYAHITATTTILSVDNAVDEIDRVIHCALKEKRPVHIHLPIDVALTEIEIPHAPKVYTHESQNVDAYIQAVEKKLMSAKQPVIIAGHEINSFKLHEQLEQFVNQTNIPVAQLSLGKSAFNEENEHYLGIYDGKIAKENVREYVDNADVILNIGAKLTDSATAGFSYKFDTNNIIYINHNDFKAEDVISDNVSLIDLVNGLNSIDYRNETHYPSYQRSDMKYELNDAPLTQSNYFKMMNAFLEKDDILLAEQGTSFFGAYDLSLYKGNQFIGQPLWGSIGYTFPSLLGSQLADMHRRNILLIGDGSLQLTVQALSTMIRKDIKPIIFVINNDGYTVERLIHGMEEPYNDIQMWNYKQLPEVFGGKDTVKVHDAKTSNELKTVMDSVKADKDHMHFIEVHMAVEDAPKKLIDIAKAFSDANK

SEQ ID NO: 798 - protein, 348 aa, Achromobacter xylosoxidans
MKALVYHGDHKISLEDKPKPTLQKPTDVVVRVLKTTICGTDLGIYKGKNPEVADGRILGHEGVGVIEEVGESVTQFKKGDKVLISCVTSCGSCDYCKKQLYSHCRDGGWILGYMIDGVQAEYVRIPHADNSLYKIPQTIDDEIAVLLSDILPTGHEIGVQYGNVQPGDAVAIVGAGPVGMSVLLTAQFYSPSTIIVIDMDENRLQLAKELGATHTINSGTENVVEAVHRIAAEGVDVAIEAVGIPATWDICQEIVKPGAHIANVGVHGVKVDFEIQKLWIKNLTITTGLVNTNTTPMLMKVASTDKLPLKKMITHRFELAEIEHAYQVFLNGAKEKAMKIILSNAGAA

SEQ ID NO: 799 - protein, 375 aa, Horse
MSTAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 800 - protein, 347 aa, Beijerinkia indica
MKALVYRGPGQKLVEERQKPELKEPGDAIVKVTKTTICGTDLHILKGDVATCKPGRVLGHEGVGVIESVGSGVTAFQPGDRVLISCISSCGKCSFCRRGMFSHCTTGGWILGNEIDGTQAEYVRVPHADTSLYRIPAGADEEALVMLSDILPTGFECGVLNGKVAPGSSVAIVGAGPVGLAALLTAQFYSPAEIIMIDLDDNRLGLAKQFGATRTVNSTGGNAAAEVKALTEGLGVDTAIEAVGIPATFELCQNIVAPGGTIANVGVHGSKVDLHLESLWSHNVTITTRLVDTATTPMLLKTVQSHKLDPSRLITHRFSLDQILDAYETFGQAASTQALKVIISMEA

SEQ ID NO: 801 - protein, 338 aa, Pseudomonas fluorescens
MKVFYDKDCDLSIIQGKKVAIIGYGSQGHAQACNLKDSGVDVTVGLRKGSATVAKAEAHGLKVTDVAAAVAGADLVMILTPDEFQSQLYKNEIEPNIKKGATLAFSHGFAIHYNQVVPRADLDVIMIAPKAPGHTVRSEFVKGGGIPDLIAIYQDASGNAKNVALSYAAGVGGGRTGIIETTFKDETETDLFGEQAVLCGGTVELVKAGFETLVEAGYAPEMAYFECLHELKLIVDLMYEGGIANMNYSISNNAEYGEYVTGPEVINAESRQAMRNALKRIQDGEYAKMFISEGATGYPSMTAKRRNNAAHGIEIIGEQLRSMMPWIGANKIVDKAKN

SEQ ID NO: 802 - protein, 343 aa, Anaerostipes caccae
MEECKMAKIYYQEDCNLSLLDGKTIAVIGYGSQGHAHALNAKESGCNVIIGLYEGSKSWKRAEEQGFEVYTAAEAAKKADIIMILINDEKQATMYKNDIEPNLEAGNMLMFAHGFNIHFGCIVPPKDVDVTMIAPKGPGHTVRSEYEEGKGVPCLVAVEQDATGKALDMALAYALAIGGARAGVLETTFRTETETDLFGEQAVLCGGVCALMQAGFETLVEAGYDPRNAYFECIHEMKLIVDLIYQSGFSGMRYSISNTAEYGDYITGPKIITEDTKKAMKKILSDIQDGTFAKDFLVDMSDAGSQVHFKAMRKLASEHPAEVVGEEIRSLYSWSDEDKLINN

SEQ ID NO: 803 - DNA, 20 bp, Artificial sequence
  LA135
cttggcagcaacaggactag

SEQ ID NO: 804 - DNA, 7523 bp, Artificial sequence; identical to SEQ ID NO: 480
  pLA34

SEQ ID NO: 805 - DNA, 90 bp, Artificial; identical to SEQ ID NO: 522
  LA512

SEQ ID NO: 806 - DNA, 90 bp, Artificial; identical to SEQ ID NO: 523
  LA513

SEQ ID NO: 807 - DNA, 29 bp, Artificial
  LA516
ctcgaaacaataagacgacgatggctctg

SEQ ID NO: 808 - DNA, 30 bp, Artificial; identical to SEQ ID NO: 608
  LA514

SEQ ID NO: 809 - DNA, 29 bp, Artificial
  LA515
tgtttgtagccactcgtgaacttctctgc

SEQ ID NO: 810 - DNA, 6903 bp, Artificial; identical to SEQ ID NO: 649
  pLA71

SEQ ID NO: 811 - DNA, 6924 bp, Artificial
  pLA78
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttccaattaccgtcgctcgtgatttgtttgcaaaaagaacaaaactgaaaaaacccagacacgctcgacttcctgtcttcctattgattgcagcttccaatttcgtcacacaacaaggtcctgtcgacgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaagtttaaacatgtataccgtaggacagtacttggtagatagactagaagagattggtatcgataaggttttcggtgtgccaggggattacaatttgacttttctagattacattcaaaatcacgaaggactttcctggcaagggaatactaatgaactaaacgcagcatatgcagcagatggctacgcccgtgaaagaggcgtatcagctcttgttactacattcggagtgggtgaactgtcagccattaacggaacagctggtagttttgcagaacaagtccctgtcatccacatcgtgggttctccaactatgaatgtgcaatccaacaaaaagctggttcatcattccttaggaatgggtaactttcataactttagtgaaatggctaaggaagtcactgccgctacaaccatgcttactgaagagaatgcagcttcagagatcgacagagtattagaaacagccttgttggaaaagaggccagtatacatcaatcttccaattgatatagctcataaagcaatagttaaacctgcaaaagcactacaaacagagaaatcatctggtgagagagaggcacaacttgcagaaatcatactatcacacttagaaaaggccgctcaacctatcgtaatcgccggtcatgagatcgcccgtttccagataagagaaagatttgaaaactggataaaccaaacaaagttgccagtaaccaatttggcatatggcaaaggctctttcaatgaagagaacgaacatttcattggtacctattacccagctttttctgacaaaaacgttctggattacgttgacaatagtgacttcgttttacattttggtgggaaaatcattgacaattctacctcctcattttctcaaggctttaagactgaaaacactttaaccgctgcaaatgacatcattatgctgccagatgggtctacttactctgggatttctcttaacggtcttttggcagagctggaaaaactaaactttacttttgctgatactgctgctaaacaagctgaattagctgttttcgaaccacaggccgaaacaccactaaagcaagacagatttcaccaagctgttatgaactttttgcaagctgatgatgtgttggtcactgagcaggggacatcatctttcggtttgatgttggcacctctgaaaaagggtatgaatttgatcagtcaaacattatggggctccataggatacacattacctgctatgattggttcacaaattgctgccccagaaaggagacacattctatccatcggtgatggatcttttcaactgacagcacaggaaatgtccaccatcttcagagagaaattgacaccagtgatattcattatcaataacgatggctatacagtcgaaagagccatccatggagaggatgagagttacaatgatataccaacttggaacttgcaattagttgctgaaacatttggtggtgatgccgaaactgtcgacactcacaacgttttcacagaaacagacttcgctaatactttagctgctatcgatgctactcctcaaaaagcacatgtcgttgaagttcatatggaacaaatggatatgccagaatcattgagacagattggcttagccttatctaagcaaaactcttaagtttaaactaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgttgtaatcgttcttccacacg

SEQ ID NO: 812 - DNA, 6761 bp, Artificial sequence
  pLA65
gatccgcattgcggattacgtattctaatgttcagtaccgttcgtataatgtatgctatacgaagttatgcagattgtactgagagtgcaccataccaccttttcaattcatcattttttttttattcttttttttgatttcggtttccttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagataacttcgtataatgtatgctatacgaacggtaccagtgatgatacaacgagttagccaaggtgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttacctggtaaaacctctagtggagtagtagatgtaatcaatgaagcggaagccaaaagaccagagtagaggcctatagaagaaactgcgataccttttgtgatggctaaacaaacagacatctttttatatgtttttacttctgtatatcgtgaagtagtaagtgataagcgaatttggctaagaacgttgtaagtgaacaagggacctcttttgcctttcaaaaaaggattaaatggagttaatcattgagatttagttttcgttagattctgtatccctaaataactcccttacccgacgggaaggcacaaaagacttgaataatagcaaacggccagtagccaagaccaaataatactagagttaactgatggtcttaaacaggcattacgtggtgaactccaagaccaatatacaaaatatcgataagttattcttgcccaccaatttaaggagcctacatcaggacagtagtaccattcctcagagaagaggtatacataacaagaaaatcgcgtgaacaccttatataacttagcccgttattgagctaaaaaaccttgcaaaatttcctatgaataagaatacttcagacgtgataaaaatttactttctaactcttctcacgctgcccctatctgttcttccgctctaccgtgagaaataaagcatcgagtacggcagttcgctgtcactgaactaaaacaataaggctagttcgaatgatgaacttgcttgctgtcaaacttctgagttgccgctgatgtgacactgtgacaataaattcaaaccggttatagcggtctcctccggtaccggttctgccacctccaatagagctcagtaggagtcagaacctctgcggtggctgtcagtgactcatccgcgtttcgtaagttgtgcgcgtgcacatttcgcccgttcccgctcatcttgcagcaggcggaaattttcatcacgctgtaggacgcaaaaaaaaaataattaatcgtacaagaatcttggaaaaaaaattgaaaaattttgtataaaagggatgacctaacttgactcaatggcttttacacccagtattttccctttccttgtttgttacaattatagaagcaagacaaaaacatatagacaacctattcctaggagttatatttttttaccctaccagcaatataagtaaaaaactgtttatgaaagcattagtgtataggggcccaggccagaagttggtggaagagagacagaagccagagcttaaggaacctggtgacgctatagtgaaggtaacaaagactacaatttgcggaaccgatctacacattcttaaaggtgacgttgcgacttgtaaacccggtcgtgtattagggcatgaaggagtgggggttattgaatcagtcggatctggggttactgctttccaaccaggcgatagagttttgatatcatgtatatcgagttgcggaaagtgctcattttgtagaagaggaatgttcagtcactgtacgaccgggggttggattctgggcaacgaaattgatggtacccaagcagagtacgtaagagtaccacatgctgacacatccctttatcgtattccggcaggtgcggatgaagaggccttagtcatgttatcagatattctaccaacgggttttgagtgcggagtcctaaacggcaaagtcgcacctggttcttcggtggctatagtaggtgctggtcccgttggtttggccgccttactgacagcacaattctactccccagctgaaatcataatgatcgatcttgatgataacaggctgggattagccaaacaatttggtgccaccagaacagtaaactccacgggtggtaacgccgcagccgaagtgaaagctcttactgaaggcttaggtgttgatactgcgattgaagcagttgggatacctgctacatttgaattgtgtcagaatatcgtagctcccggtggaactatcgctaatgtcggcgttcacggtagcaaagttgatttgcatcttgaaagtttatggtcccataatgtcacgattactacaaggttggttgacacggctaccaccccgatgttactgaaaactgttcaaagtcacaagctagatccatctagattgataacacatagattcagcctggaccagatcttggacgcatatgaaacttttggccaagctgcgtctactcaagcactaaaagtcatcatttcgatggaggcttgattaattaagagtaagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaacacctgtggtg

SEQ ID NO: 813 - DNA, 90 bp, Artificial Sequence; identical to SEQ ID NO: 650
  895

SEQ ID NO: 814 - DNA, 81 bp, Artificial Sequence; identical to SEQ ID NO: 593
  679

SEQ ID NO: 815 - DNA, 20 bp, Artificial Sequence
  681
ttattgcttagcgttggtag

SEQ ID NO: 816 - DNA, 22 bp, Artificial Sequence
  92
gagaagatgcggccagcaaaac

SEQ ID NO: 817 - DNA, 25 bp, Artificial Sequence
  N245
agggtagcctccccataacataaac

SEQ ID NO: 818 - DNA, 25 bp, Artificial Sequence
  N246
tctccaaatatatacctcttgtgtg

SEQ ID NO: 819 - DNA, 90 bp, Artificial Sequence
  896
ttttatatacagtataaataaaaaacccacgtaatatagcaaaaacatattgccaacaaaaattaccgtcgctcgtgatttgtttgcaaa

SEQ ID NO: 820 - DNA, 90 bp, Artificial Sequence
  897
caaactgtgtaagtttatttatttgcaacaataattcgtttgagtacactactaatggccaccttggctaactcgttgtatcatcactgg

SEQ ID NO: 821 - DNA, 28 bp, Artificial Sequence
  365
ctctatctccgctcaggctaagcaattg

SEQ ID NO: 822 - DNA, 26 bp, Artificial Sequence
  366
cagccgactcaacggcctgtttcacg

SEQ ID NO: 823 - DNA, 28 bp, Artificial Sequence
  N638
aaaagatagtgtagtagtgataaactgg

SEQ ID NO: 824 - DNA, 22 bp, Artificial Sequence
  740
cgataatcctgctgtcattatc

SEQ ID NO: 825 - DNA, 83 bp, Artificial Sequence
  856
gcttatttagaagtgtcaacaacgtatctaccaacgatttgacccttttccacaccttggctaactcgttgtatcatcactgg

SEQ ID NO: 826 - DNA, 79 bp, Artificial Sequence
  857
gcacaatatttcaagctataccaagcatacaatcaactatctcatatacaatgaaagcattagtgtataggggcccagg

SEQ ID NO: 827 - DNA, 80 bp, Artificial Sequence
  BK415
gcacaatatttcaagctataccaagcatacaatcaactatctcatatacaatgaaagcattagtgtataggggcccaggc

SEQ ID NO: 828 - DNA, 26 bp, Artificial Sequence
  N1092
agagttttgatatcatgtatatcgag

SEQ ID NO: 829 - DNA, 25 bp, Artificial Sequence
  413
ggacataaaatacacaccgagattc

SEQ ID NO: 830 - DNA, 92 bp, Artificial Sequence
  906
atgacaggtgaaagaattgaaaaggtgaaaataaatgacgaatttgcaaaatcacatttcacctggtaaaacctctagtggagtagtagatg

SEQ ID NO: 831 - DNA, 87 bp, Artificial Sequence
  907
aaaaagattcaatgccgtctcctttcgaaacttaataatagaacaatatcatccttcaccttggctaactcgttgtatcatcactgg

SEQ ID NO: 832 - DNA, 70 bp, Artificial Sequence
  667
tctcctttcgaaacttaataatagaacaatatcatccttttgtaaaacgacggccagtgaattcaccttg

SEQ ID NO: 833 - DNA, 25 bp, Artificial Sequence
  749
caagtcttttgtgccttcccgtcgg

SEQ ID NO: 834 - DNA, 4242 bp, Artificial sequence; identical to SEQ ID NO: 591
  pLA59

What is claimed is:

1. A method of producing butanol or 2-butanone comprising:
   A) contacting a recombinant host cell comprising a heterologous polynucleotide, said heterologous polynucleotide comprising
      i) a promoter nucleic acid sequence, wherein the promoter nucleic acid sequence is selected from SEQ ID NO: 775, 776, 777, 778, 772, 773, 768, 769, or 711; and
      ii) a nucleic acid sequence encoding a biocatalyst polypeptide, wherein the biocatalyst polypeptide catalyzes a substrate to product conversion of pyruvate to acetolactate;
   with a carbon substrate under a first set of conditions; and
   B) contacting the recombinant host cell with a carbon substrate under a second set of conditions;
   wherein the first set of conditions and second set of conditions differ and wherein the nucleic acid sequence encoding a biocatalyst polypeptide is differentially expressed under the first set of conditions than under the second set of conditions; and
   wherein the host cell produces butanol or 2-butanone under at least one of the first set or the second set of conditions.

2. The method of claim 1 wherein the first set of conditions and the second set of conditions differ in at least one of source of carbon substrate, dissolved oxygen concentration, temperature, pH, glucose concentration, or butanol or 2-butanone concentration.

3. The method of claim 2 wherein the dissolved oxygen concentration is greater during the first set of conditions than during the second set of conditions.

4. The method of claim 2 wherein the glucose concentration is lower in the first set of conditions than during the second set of conditions.

5. The method of claim 1 wherein a rate of butanol production is lower under the first set of conditions than under the second set of conditions.

6. The method of claim 1 wherein the source of carbon substrate for the first set of conditions differs from that of the second set of conditions.

* * * * *